United States Patent 12,059,441 (PROBIOTIC BACTERIAL STRAINS THAT PRODUCE SHORT CHAIN FATTY ACIDS AND COMPOSITIONS COMPRISING SAME) - sequence listing, part 24

SEQ ID NO: 35 - DNA, 3832565 bp, Roseburia inulinivorans (residues 1-1,916,283 of 3,832,565)
cccagtgtggaagggacattccggagacgctgacgacagaggaaatttatgtactggttgacggatatggggatgccgcagagcgtgccttaaaagcaggagcagatgcagttgaagtgcatatggcacatggatatctggtaaattcttttatgtctccgagaacaaataaaagagtggatgagtttggaggatgcttcgaaaacagaatgcgattttcacgcttgattatcgagaaaatccgtgaaaaagttggcgataaacttgcagttttagcacgtattaacagttcagatgaggtgcttggtgggcttgatgtacatgacagtgcggcaattgcagcttatttagaggattgtggggtcgatgcgcttcatgtatcccgtgcggttcacattaaagatgaatatatgtgggctccaactacaatccacggaggattttccgcagaacttgtttctgaaatcaaacgtgcggtcaatattcctgtgattacagttggacgttttacagaaccacagtatgcagagcttttggtgagagagggacgtgcagatttggttgctttcggtcgtcagagccttgcagatccggagatgccaaacaaggcaaaagaggaacggttagaggatatgattccatgtatcgcttgccttcagggctgtgttccgaacatgtatcagggcaaaccgctccgctgtcttacaaacccgtgtcttggacatgagtgtgagggaatcaaaaaggcagaagtcacaaagaaagttatggttatcggcggcggtgtcggtggcttatgcgcagcatttattgccgcagagcgtggacatgatgtgacattatatgaagcaagtgatgttttaggcggaaacatgagactggcagcgttcccaccgggaaaaggtgatatcacaaacatggttcgtgcttatattcatcgttgtgaaaaagacggtgtcaagattgtgatgaacaaagaagtcacaattgactttatcaaaggagaaaatccagacgctgtcattgttgcaacaggttcaaagacactcgttcttccaatcgaaggaattgataatgaagcaattatttacggttcggatatcctagacggaaaacgtatgccgggcaagaaagtacttatagtcggcggtggtatggttggctgcgagattgcatctttcttaggagagcaggagcatgatgtaacagtcatcgaattccgtgatcaggtaggggcagatgtcatcaaagagcataagttatatctgatgaaagactttgaggaatataaaattggtcagattaccggtgcaaaagtatgtcgtttctatgaggatggtgtagagtatgagaccgcagatggtgagaagcacgagacaagaggttatgataccgttgtattatccatgggttacagaaactataatccatttgcagaccggttagaggaacttggaaaagagacgtatgttgttggagatgcaatccgcgcaaggagagcgttagatgcaacagcagaagcatacgaagcagcaatgaaattatagtgtcagtaaatgattatgaatgaaagtgaaaggatatattatgaataaacaacaaaaacatttaataattgcagtaattgtaggtgcgttaatctactttttattgcctgaggcaaatggattaacaaaacagggaatcagtatgttagccgtatttattccaacgatttatttatggcttacttgtggtacaggatggacatccctgtttagtgttacaatggcagtgttgttgaacgcagcagcgggtggttcagcatatggtactttgtggggaaatattgttggagcggcagtaattccattccttatggtggcaacagttttagaagagagtggagcatttgagtggattgtaaaatggattatttccagaaaatttattcatggaaaaccaactttatttatgatcatgtttacattagccatgattattatttctatttttacagcaccacaggttgtttctgtattattcttccggttacttagcgatgtgacaacttctattggatatacaaaagaagataaattttataaatcacagggattactgattggttggatatcacagttatgtgatgccaccttgatttggggtcgtccgtatattttaacaatggttgcaatcgttgcagcattaggatttgagaactttactgctatgacatactttaaatttgcattcctctttttggtttttgcagtaattgtagctgttttaatggtaaaattatggatgaagccagatgtttctaaatttgaaagtttcgatgatgcagcaatgagagaagaattgaaaaaaaatccaatctcaaaacgcggtaaaattgcattaggtggaatggcaattattttactttgctatattatggcatctttggagttcttaggaccggttgcttcttattttagcggaatcacaattgcagcatctgtaacacttgtatgtgctttattatgcgtaattactgttgatggaaaacctgttatggatttgaataaatcagcttccaaagtaccttggggaatgattgttttccttggagcaattatgttctacgcaggagctattggtggtgaccagtatggaattacagcttgcctgcagagtattcttggaccagtagttgcacagcttccagtaatggttacaattgtaattggattaattgttgcaagtcttgctacaaacttctgctctaatacagtatcgggtgttattatttgttcaagctgtataccggctttaatgtcagttcctggaatcagtcaggcacaggttatgggatttgcatgtgcagttattgcgatttgtggtacagcaatctgtactttgagtgcttgcccgttaatgggaattgtatattctgatatcggtattgaatacaaaggaactgcaaaatatagtgttgcattgtgcgcaatcatgattcttatctgtgcatttattttaattccggcatcttctgttttatttgcaggaatggtatagaatataatagatgaaaggggaaaagtatggcaaaatcaattgtttcacaagtacaattacttcctcgtactgaggattctgcaccatgggaggcggctgaccatcagcttgttccaatcaatttaaaacgctatggatatgttgaagaagaatatttgtattcaggcaaagcaaatgtatatacattaaaaaatggacgggcagaaattaagaccgaaaatgctgactatacgaatcgatttattcttcgaaaaccagaaaaccctgcaaaatttagtggaaatgttattgttgaattgcttaattctacaaacagttgggatgtatcaccaatgtggtgtcttttatggcagaaaatgctgcaggaaggtgatatttatattggagtaacggtcagagcaatttgtacaaaagctttaaaaacatttgatccaaatagatatgaaaaagtttcttggaagaatccaagtgtaaatcctggagaaattgaccagaaaattttactttggcagcattgctcaaaagagacagaggatggattgctttgggatatgctgacacagcttggtaatctaatgaaatcagaagaaggaagtaaaattgcaggccgacctgtaaataaagtttttgcagtgggttgttcgcagtcgtctatgcagctttctacctatatcaacgtatttcatgaaacaacaagggtttcgcctgtagaagttccatatgatggttacttaagctattccggatgtagaatggttgcattgaatcaggaagaagcacctgcagaagtaacagatgaaattcagattacaaaaaattgtccggtaccggtcattcgatgtatgacacagtgggatttcaaagattttacaggatatattggacttagacgagaagacagtgatgcactgggagacagattcagattatacgaacttgccggacaggcacacaattcattctcaggagcattttacagacctgggtacgaggaagttgaaaaactcggaaaaacagcagccttgccaagtacggatatcacaagcctgcctttggaagcatttatgcgtcaagcattagaaaatttgatattgtggtctggagatgccaatatagtgccaccgcatgcaccgtcattaattgaggtagatgaaaatcataatgaggtattagatgaaaatcgtaattgcataggtggatttcgattcccacaactggatgttccaatcgcaacatattgcagtggaacgaaaaaaaatgaccaggatagctgttttattcctttcagcgaagaaaaattaaaaaaattatatccaacgagaagagattatattgacaagatttttgaggcaattgataaattggaagaacaacgattcttttctattgttgatgcggatcagatgaaattggatattttaaaacagccagttccagtccgggatcataattccaaatttgaaaattagagtaactatataagggaaatattgattatactcctgtctttgatatttgaaagatataaaattggtcgcaaccccagcaaacaacaagggattgcggcttttttgttatttcgtgaaatgcataatgaaccggttatggaaattcttgtatcgcaaggaatatagcgattttattgactatgtcatgatcaaactaaaaatcacgcagtattttgttggactaacgactgtaatgatagcactttagtgtactaaaatatttttcttgcgcaatgtttctgaacttgctatactgagagcagaaattgtaaaaagacagtggttttacgatagaatatgtatacagcgaggagattagcagaacgatggacagaattgaagagatccgtgaaaaaatcggagaatgtgatgatattattatagagcagcttgcagtcagaatgtctcatatccaggagatcatttcttataagaaggcaaccggtatcccgattttacagccggagcaggagaagaagcagacggatgcactggcacaaaaacttggcgacaatgagttcgaggaagagattcttgatattttcaaatatatcatgaagaacagccgcaggatccaggcaaagagtctgttcgattacaatattttcctgatcggtttcatgggagccggaaagagcacgatcgcaggagaactgaaggataagcttgagatggatcgtgtcgagatggatcagatgatcgtggagaaacagggtatgtctatctcagaaatttttgatgagtatggggaagcttatttccgtaacttagagagcaatacactgatcgagctgcagaagagaaagcagacgatcgtttcctgcggtggtggtgttgtcatgcgggaagagaacacagaccatatgaagaaaaatggccgtgttgttttactgacagcgaagcctgagactatctatgagcgtgtcaaggacagtgacgagcgtccaatcttaaatgatcatatgaatgtggagttcatcagcagtctgatggataaacgaaaagaacgttatgaggcagttgcggatattacggtggcaacagatggcaagaatgtgacacagatctgtgaggagatcatttcaaaactgatcgcactcgacaatgcaaaagaagagcaggaaaaaaacaaatagctgaaaaacagcttttgtcagtgtgaaagcggggataaagggaatggaatatgatgcacaagtatttaagatgaaggcaaacaaaaaggcgcgcaatgtctggatggcattgtcattgatcctttcactgtcgtacacgtcagatacggcaaagggattacatacgctgccttactatgcaatgtttatggcgatctgctggatcccgtttttgtttggagtggtggtactacgtctgcagggagcagcaacgcagtattataaatttattgttgcggtcgggtatggtgtgttttatgcatttgttgtctgtacaagtgaatcgatactgtcatttatgtatatatttcctctgacgagtatgctggttttgttcaaagacaggacatatatggtgcaatgtggcattggtacattagtgatcagtattgccagcagtgtacataaatttatgaacggaatgaacagtgcatccaatgtgaatgattacacattgcaggcatcctgtatcatactttgttatatctgctatgttgtgtcgatcgaccatctgaatgagtcagacggtgcattgaccaattccatcaaagcggatttagagcgggtggttacgactgttgagcaggtaaaaggtgccggtaatcagatcatggacggagttacggttgtcagggaattagaggatgaaaacagacagagttccacgacagttgtgcagggaatgagtgaactgacgcagaacaataacgtccttcatgataagacaatgtcctcgatggacatgacgaccaacatcaatgagcagatggaacgcatggcatccctgatggaacagatggtcactctgatgaacgaatccgcagaccatgcaaatgaaagctccggagaattatccagagtggcagagacaacaatgctgatggcaaagctgtccgacgaagttgagacgatcctctcagaattccagaaagagttcgagcgtgtgaaaacagaagtcagcaccattgaatccattaactcccagacgaatctgctggcgttgaacgcatcgatcgaagcagcgagagcaggagatgcaggaaaaggatttgcagtcgtagcagatgagatccggaacttaagtacagagacgcaggagtcttcgagccgtatcatggaggcactcgcaaatcttggaaccacttccgttaagatgacagattctatcggacagaccatcaatctgatccaggagacctctgaaaaagttgcagtggtcaacgagagtgtgtcaggaattgcaaaagatgcggcggaacttgaacaacatctgagtgtcattgattccgcaatgcaggatgtaaaagaatccaaccatcagatggtttccaatatggagggaatctgtaatgtcatgaatgccatgacagacagcattggaagtgcagatggcgcaacaaagacaatgctgaacaaatacgatgagtcctcacgcaatgtgaataagatcgagaccgttgttcaggatatgatggaaaaactaggtgtcggtggctttatgggcattcaggatgtcaaaccgcagatgcattgtgttttagtcggaaaaggagaaacacgggaagaatatcatggaatagtcgtaagacagagtggcagcgagttatggcttcagctggatcggaaagcactggaacgcatccgggaaaagacaccatatgatattcagatcgtggttgataatgtcctttacaactggaaggatgttctggcaaacgtggaaaatgagcagggaagagatgtttgccatttagtggtaaaaacaacacctgtcattgcaaacagaagaaaatatccgagaatgccgatcgcaaattcctgtacgatcacgagaaaagatacggataaaacatattgcggaaaaatggtcaatgtcagtgcgaatggatttgcatttgcagcagcatcagacgattttgcggaacttaagggaacacagctgatactcgatattccggattttccggtaaaagaggaacgcaccatggaaggcgtggtgatcagaagcacggacaatcacggagaatatattgtgggatgccgtatgccggaagacagtccggccattcagaaatatgtaaatgataattataaggaataaaaaaatgtctggcgggattttttcgccagacattttgctcgaaaagcaaggaggatatatgacgtatcatcggttagaaaacagtattattgatgtgatcaaggaggagcaggcaaaacttggataccgcaaagaggagattcgtttgtattatccgctcagctccctggatcacttttttgagacagaggcggatgcagaggagatgaaaaagatcctggcgggatttggtgcatatacaaaggaaaaactggggaatgtgctggtatccaataaaggggatcgattttgtttccatataccggagcagggcgcagaatatgtgcatgcgcatatgaagccgaatgagtttatccgggagttggtagagctggtcggaaaacatggctgtacgatgcagcaggtgaaagaccttttcctctcaaagggaaagcaggttcaggtggagccgatggataatggagagtttgatcttatgatccgctttgaaggagatggagaagacccgtattactattgctttaaagatgagggatgtcacattatttatcacagatttttgccggaggattatgctgacttcggtttttaatatttcttgacagatgtctgattccatattataatctgtatcatataaaacatatagaaatagtgggaaataagatgacgagagaaattttatgctttggcgattctaatacatatggtttaataccgggaacaaaagaacgatataaagaaaatatccgctggacaggaatattacagcagaagttaaaggagcaggactgccgtattgtagaggaaggactctgcggaagaacgacggtttttgaggatgaacttcgcaaaaatagaaagggcagtgatttattacctgttttattagaaagccatgcgccaatcgaccaggttgttctgatgctagggacgaatgactgcaaatcctattatcatgcctcggcagaggtgatcggtctcggagtagagaaactcatcgggcagatcagacaggagggagaacatattaagattcttctggtctcaccgatccttctcggagaaaaagtatgggaaccggaatatgatccggagtttgatgaacagtcagtggagacatccagacagttaaaaacggtttacagcagaattgcaaaaaagcatgggattgatttccttgcagcatcggatgttgcagagccaagcagcagggacagggaacatatggacgaggaaagtcatcgcagatttgcagaagcggtctatgaaagacttgcaggataaagaaatgagaagaagcagataccgggagaggactgattcttttttgaggaataataaaagaaaaagtacaaaaactatattgacaaaagaaaataaattgtgtacaatctatttatcaaaaaaattgcacacaatttaatttgagacaatatgaataaatgcttattatcacaatgaagaaacagaatattctggaacaaagtatttataacaggaatggaggtagagatggaacggtatgatattgcaatcataggtaccggaccggcaggactggaggctgcgatcacagcgaagatccgcaataagaagattattttatttggaaataaaaatctgagcctgaaagtggaaaaagcgcatacaattcagaattatctcggcttgccagacattggcggtgaggaactgaaagctgcttatgaagcacatttaaaagcgatggatattgagatcacagaagataagatcaacgcagtttacgcgatgggcgagtattttgccttgcagggaaatggaacaaactatgaggcacagacagtcattcttgcaaccggagtcagcactgcaaaggcatatccgggtgaggagcagtttttaggcagaggcgtcagctattgtgccacctgcgatgcacctttatacagaggaaaaacggcagcgattatcggtttttctccgaaggaggaagcggaagccgactttatggcggagatggcagacaaagtttattatattccaatgtatgaagccgatgtcaatgtggcagattccgtcgaagttttgagggaaaagccagtgtccgtcgagggatcattaaaggttcaggaacttgtgacagaccggaaccgatatgatgtggatggagtattttttttaagagaaagtgtttctcctgcacagttagtgccaggacttaaaatagaggacaatcatattgcggttgaccgtcagatgcgcacaaatcttgcaggttgttttgcctgtggcgacgcggtcggtgcaccgtaccagtatatcaagtctgcaggagagggcaatgtagccgcactttcagcagttgcatatctggcagagaaaaaacgccagtcaaagtaaatgataagaaggagaaaaaattatggtaaagaaaatttcacagaacgaatttaacgaagtaatagcaagtgaggtagcagtcattgatttttctgctacatggtgtggaccatgtaaaatgttagcacctgtattggaggaggtttccgaggaatatgcaggaaaagtaaactttttcaatgtagatgttgatgagaacccggatctcgcaatgcagtacaaaatcatgaatatcccggcacttgtcgtattgaaaaagggtgaaaaggtcgatacacaggtaggtttcgctccaaaagaaaatattgtagaatttattaaaaaacagttataataaaagaaagcggcgcttaccacagtaagggcaacaggatgacaatatggaaaaatacgatgcattgaaactggagaaacagctttgttttccattgtatgcagtatcaaaagaaattgtaaaaaagtacaagccatatctggatgaactggatctgacttacacacagtacattacaatgatggtcatgtgggagcataaggagatgaatgtgaaggagcttggggaacatctgtacctcgactccggaacactcaccccggttttaaaaaagctggaacaaaaaggctgggtgaaacgaaaccgggcaaaagaggatgagagagttttgatcgtcacgctcaccgcagaaggcgaaaagttaagagataaagcagtggaaattccacaaaaagttggtgggtgcgtctgtcttgatcaggaagaggcagcatcactttataaaattttatataaaatattggggaatatgtaattatttgcagattttcagattgattgcatagggcaaaagaaaatgttgcggtaatcattaacaattttaacaggtcaggcgtattgccagactacatagaaaaggagaagagcagcatggaaaaagtgaattttggtgtaacaaagcgaggggaagaagcctcgttatatgtgttggagaataaaaacaacacaacgattaaggtgacagactatggtgcaacactggtttctcttttatttgcggacaaggcaggggtacagaaagaccttgtacttgggtatgataacgtgaccggatatgaggaacataccagttactttggggcgattatcggacgaaacggaaatcgtatcaaagacagccggtttacgatcaatggaaaagagtacaggattgacgagaatgagaatcataataatctccacagtggaaaaaacgggtttaacacggtcatctgggaagtgagagaacacacggacaatagcatcacattttatcactacagttcagagacagagcagaaattcccgggcaacatggagattaccgttacatacacgattgcagatgatgatacactgcatattgtatataatggaaaagcggatgcagatacggttatgaactgcacgaatcattcctattttaatctgaatggtcacgagagtggaagcattgaaggacaggtattgcagattttcgcagatgcctatacgccagtcgtggattcaagtgcgattccgacaggagagattgcatcggtggagggaacgccgatggatttccgaacagaaaaacagattggacaggatatcagggcagattttgaacagcttcattttacaggcggttacgatcacaattatgttctcggcagaccaggtgagaaaaagattatggcaaacgcatactgccgggagagtggaattgccttagaagcggaaactgactgctgtggtgtacagttttatgcaggaaactttatcggagagcagaccggaaaaggtggtgcatcctatcacgacagaagtgcattttgtctggagtcccagttttatccaaatgcggtgaatgaaccggattttccgtcaccggtggtgaaagcgggacatacctatcacacggagacaagttaccggttttatctgagatagggttgaaacgataaacgaatcaggatgaaagtgctgataaattgtattgacagaataaacagccgattttgtcagaaatatagttgacttcgggggaaaaaagtgctattctccaatatagcatgaaaagtgataattatgagtgagtctatagctgataattaagtgaaagcgatgataagagttagtacgtttcctatgatgtgcagagagaaggcggtcggtgcgagcctttcatgatgaaaacggaacctgtctttgagcgtgaagtgaacgtggatattgtagccgcaatctgcatcagatgttgaaaagcagcgcggattcattaataagcttcatcgggagctcccgttacagagctggcatatcggatatttcctgtatgcgtgagagcggttttaccgaaattaggtggtaccacggacagatagttcgccctaagctgatattttcatattggcttggggcttttttagtgcttcgaaaatatctgtattcaaaaaaatagacaattgcgaaactcataacaacctaaattgaattgtgagaaattgacaaaagacatgaaagacattggggagccgccggcacttagaaggcaggtacaacttttttcaatcaggtctgtgcatttactgcacagaccgtgcgaaagtgattcaagtgtgagcaaattcctatctgcgaagcagattttaaatgaatttgcgaagtactgcgaagaatgagcagtaccgttgcgagcgacacatagcgagagcgtgtcttgaatgtttttgttaattttgaacaattgaaagaagactaggatgagtttcgcaaacgcctaattcaaaaaacaagaaaaggagaaaggattatatgaaattagaaaaattagtaggtgacagatttaaggaaagaccggcggattgtcaggtagacagccacgcacttatgatccgtggtggttacatgaagaatgtggcaaacggaatttactcttcttatatgccactccgcagaattacaagaaagatcgagcagatcatccgtgaggagatggatgcgattgatggacaggaagtacagtttccggttgttatgccggcaagtctctggcaggagtctggcagatacgacagcatcggaaaagaacttttacgttttacagaccgaaacggagcgcagatggttcttggtatgactcatgaggaagcagccgttcagttagtaagagaatatggacagagctatgcaaaatacccatttatgatctatcagatccagacaaaattccgtgatgaggcacgtccaagagcaggattgatccgtgtgcgtgagtttaccatgaaagatgcttattctttccacacaagtcaggaagatttagagcagtactatgataaatgccacaaagcatatgagagaatctatgcaagagcaggtatcccggaggtagtttctgtaaaatccgattccggtatgatgggcggaaatgtttcccatgagttcatgcttttaactccaatcggagaggattccatcgtaatctgtaatgagtgtgattaccgtgccaatatggaagcagccgaaaatattgtagagaacgagacagaggctatgcaggagctgacaaaggttcatacacctgagatgcatacaattgaacaggtttgtgaatttttacatgtggatgcaaagaaatccatgaaagccgttgtttaccagaaaaattccgatgacaaatatattctcatttttgtgcgcggtgacctcgaaattaatgagacaaagctgaccaattaccttggctgcgatgtccatccggcagtgatcacagaggagagtggcattcaggcaggatttatcggaccggtgaaccagaatgcagactgtatcgttttatttgaccgttctttaaagggaacaacaaatcttgtctgcggcgccaatgaagtggattatcattacacaggcctgaatatggagcgcgagttcccggatgcagagtatgttgatcttgcaaaagttgtggtgggcggtatctgcccatgctgcggtaagaaatcactgaccatttcccgtggtattgaggttggtaacatcttccagctcggaacgaaatacaccaagaccatgaacatgacctatgtggacaaagatggcataagcaaaaatccaattatgggttgctacggtatcggtgtcggacgtatggcagcttccatttgtgaagcacatcatgatgattatggtccaatctggccaatgagcattgctccgtggcaggttcacatctgtgcgatgaaccttgacaaagaaggtgtcagggaagtagcagatactttgtatgagaatttacagaatgccggtgtggaagtgatctatgatgaccgctccgtaagtgccggaaataaattctccgatgcagaccttttaggggttccggttcgtgttgttgtgagcccacgtaacttaaaagagtctgttgtggaagtttccacccgtgacaagagccttatggagaaagttccggtagaaaatgccgagcagtatgtaaaagaccttgtagagaaaatgaaaaaagagtgtaatctggtaaaataaatggaaaaaataaacggaatcccgatgatttcatttggacttcttggcggtttctgtgatcatctggaaatcagaatcacaggactgtcggaggaaggtttttcgtttcgtgtaccggaaaaaatagaaaaagcggcgtgccttgagatttgtttttttgacttttctgctgactgttaccgcaaagtgcagttggcagagaaggaaagagagatgaagttaacagaggagacgccttttttctttatctattcggtgtggacaaaaaacggggaatacagggagcaggtaaagcgtctggtgacagattatgacaactacatatcgctaaaactcgcaggagatgatgcgtatctttcagaaaaaatggttggttatccggcagaattggacgaagtttacgcagagaacttcgaagagcagaagaaagagtggttcagttgtgttggtgatggaatacaggagtgcaggaatacgtgggagcataaaaagtggaatattacagatttccctgaattcgagctcgccatcacaatagaccgcccggaattatattatgattttctacaaaaagactggacgagattttgccacgattactggaaaaacaattttttggaacatcacacattgagtcagaagagagtgacaagaatctacattggaaaccagttctgccacaacctttttccaaggaaagaattgctgtttcaggtgttggagaaagcgttggagaacaatcttgcggtgacgcttgccttctcatatattaggaatcatctgttggaagagattgatgaactgttgcaggaacttgaagtatggtgccaaagcagagaaaaagaggcaggcaaggatcaggaggaaattatcgtaaacgactgggcgatgcctatacttctgcagggaaaaccacacttaaaaccagtgttgggagttctgttaaataaacgtagaaaagatgtccgtttaccttataaacatggtatcgggaatcatgtggacagtctggcagaaaataatttgaattgtggattttatcaggattatttaaaaaatacattcgatatacaaagatttgaatttgaatcatgtggatataaggttacaatcccagatggacaccacagcctgcatcttccttttttccagacaaatacctcgcagtattgtacgctttatgccgtttgcagatatggtgacaggggaaaacaaaagttgccggaaaactgcccaagatattgtaacaaaaaagtatttctatatccgaagcatttgaaaatggtgggaagatataattcactgtttggatatgatgagaaaatactgtgggatgaaaaacaattgcaggattatctcgaacaggggattgaccggattgttgtgaatgtttctttgtaatagtaggacattgtctggacaggaatgcatttttatatagaaaacgattccgctgaaatgcaacaggggagaaaaatacgatggagtctgttcttgaccgtgtaatcaagcagaacacggaaaatgtaaattaattaaaaacaaaagattacaatattttttctgttttacagatacagtcaaaggaagttctgatctgccgcatgatagctgaccttttaaatccgagagggcagcatggcgcaggggcagagtacttaaaaattttcttgagagattgtcttggaatggaaaaaatggatacaaaactggcagatcaggcaattgtgacggcagaatatgcgattgatgatgagcggagaatcgacattgtaattgaaattggcagctattttcttccgatagaagtgaaaatatatgcggctgaccagaaaagccagtgctttgattattatcagtatgcaaaaagaagagatgcgcaggcgaaagtgtattatctgacattggatggacacagaccgggaaaagacagcacatcttctggcagccagtcagtaccggaggaggatatcgtctgtctctcattccgtgagcacattttaaactggctgaaggcatgtaaaaattgtgaaaatacaggaatgattcctattttagaacagtttatcaggaatatagaacagataagcggctatacaagtgagagggtgagaaacatggtaatcgatgaattgctgacatccggtgattccttaagagcggggatgcagattgcagattctatcaatgctgcaaaagcaaagctgatctatcaggtgatggaggaatttgagaagcagttagcaggagttgcggaaaagaatcattggacaagggagaaaaacagtaactggtacgaatataaagagcaggcagatgaatttttttataaatggtattctacctatccgggaatcaactacattgtaaatgacgccccgatgccggatggaaagcagctctggttccgtgtggaggtagaacattgtctgttcgcgggattctgtgtctttgatccgaatgcagaatcggaggaaggacacggggatcaggtggatgaatatgatgctgcaactgtaaaagcagtcgggcattatctgaaaatcagtgcggcagaccacaaggactggtgggcaaccaggtggtatctgccagccggagaacagaagccaaacgattccgttccgaactttaaaatcatgaatgatgcagcaatcgcactggcagataaagagtgccggtcggagtttgtatcattgtgtgttcgtaacattgaggagatggtggagagagtgcttgctattccagaatgaaaaaattataataaaataagtatgtagtggattggaaaggagaagctgttatgaacaaacgtaagaaacttccaattggaattgagagttttgaagagatgcggaaagaagatttttattatgttgataaaacgagatggatcgagcagcttctcgcccagtggggaaaggtaaatctttttacccgtccacgctggtttggaaaatctttaaatatgagtatgcttcagacattttttgaggtaggagcagatgcatcactttttgatggattgtatatttcaaagaataaagaagtctgcaaacagtatcttggaaagtttccggttgtatccatcagtttgaaaggcgtgaatggaaacactttcgacgaggcacggagctgtcttgtaaaagttatcaacagagaagcgcgtagattgcagaacttatcagaaagtgaaaaactgacacaggttgataaggaactttttgaaaaattgttttctcagatgaaggatgatggaacgttaagcagcagcttattggaactttcagaacttttggaaaaacattatgaagaaaaagtgatcgttttgattgatgagtatgatgtgccacttgcaaaagcaaatgaaaatggctattacgatgagatggtacttttgatccgtaatttatttgaaaatgtgttaaagacgaatcacagtttgaagtttgctgtgttgacaggatgccttcgggttgcaaaagaaagcatttttacaggattgaataattttaaagtttattccattacggatgttgattttgatgaaaactttggctttacagatgatgaagtaaaagagttgcttcattattatggtcaggatacacattatgagacggtaaaagaatggtatgatgggtatcgttttggaaatgttgatgtatactgtccatgggatgtgattaactattgcagtgatcatattgcaaatcaggagtgtgcaccaaaaaattattgggtgaatacaagcggaaatgatgtgatccatcgctttatcaatagtatttatgaaccgcagaaactcacaaaactggagttggaacatcttgtgaatggtggaagtgtccagaaagaaatcagtcaggagatgacctataagaaattgtattcatcaatcgataatctctggagtaccctttttatgacagggtatctgacaagccgcagcaatacggatggaaacaggtatgatcttgtgatcccgaatagagaaatcagaaatattatcacagaacatattctgaaattatttaaggagaatattaagcaggatggtcagaaagtaaacgctttttgtgatgccttattaacagagaaagcggatgtggcagagaagcttttttcagattacatgcaaaaaacgatcagtgtgagagatacttttgtacagaagccgacaaaagaaaatttttatcatggaattttgcttggaattcttgggtttaaagaaaactggcttgtgacatcaaacagagaatctggagatggatttagtgatatcatgatccaggtaggagattctgaggtcgggattgttattgaggtgaagtatgccaatgatggtaatctggaagcagagtgcaaaaaagcattgaaacagattgatgatacagggtatgcagaagcgttgcatcaggacggaatctgtaaaatcttaaaatatgcgatcgcatgttataagaaaacctgtaagattatgttagaggcagaaaaatgttaaaaaataaaatttttacatggatgacattgggtgaaatatctttgttataacatggttcagagaggattttttatgggaagttatcttaatccgggcagcacagcatttcagggaagtctgcggtcacaaatttatattgataaaagcggactgattgaaaagacgaacacagtgcttggcacagagcagaaatatgtctgcgtgagcagaccaagacgattcggaaaatctatggcagcaaatatgcttgcggcatattatgacagagattgtgatacgaaggaattttttgataaacttaaaatcagtcagtcagaagagtatctgaaacatttgaaccagtatgatgtgttaaaaattaacatgcaggatttcctgagtggaacacacagtatggatgagatgttagaacagttgcaaaaacaggtgatgaaggacttgaaaatcagatatccggaatatgccaaagaagataatctgatctttgtcatgcggaatatattttccaatacccatcatccttttatcattctgattgatgaatgggattgcctgttccgcgaatatcaacaggataaagatgcacaaaaaaaatatctggattttctgcgtttctggttgaaagacaaagattacattgctcttgcatacatgacagggatacttccgataaaaaaatacggttctcactcggcattgaatatgtttatggagtactcgatgaccgatccgggagaactcgcagaattttttgggtttacggaagaagaagttaagggattgtgtgaggaatatgccatgaactttgaagaagtcaaagcgtggtatgatggatatgatctgatttcacatagtcgtttgggcgacaaaagatattcaatttatagcccgaaatcagtggtagaagcgatgctgcggcacaaattcggcacatactggaaccgaacagagacctatgaggcactgaaaatatatattcagatgaatatggatggattgaaagattcagtgatccagatgcttgcaggggagggtgtgcgtattaataccggaacattcagcaacgacatgacaacttttgcaacaaaggatgatgtactgaccttactggtgcaccttggttatctgacatataacagtgagacagagaaagtgaccattccaaacaaagaagtgtcacaggaatatctcaatgccatcagtaccatggactggcacgaggtaatgcgttcggtcgaaaattcgcgtaagttagtggaagcattatggaatcaggatgcaaaagcagttgctgccggaattgagaatgtccatgatgagatttcaattcttcagtatcgtgatgaaaactcattgagttgtaccattcatctggcattctattttgcaagagaatattatacgatcatccgggaactgccgacaggaaaaggttttgcagatatctgcatgatcccaagaaaaatacacgcagataagccggcagtgattattgaattaaagtgggataaggatgcagaaggtgcaatcgcacaaataaaagagaaaaagtatgtgaaatccttagaggattacaaaggtaatcttctgttagccggaattaattatgataaaaagacaaagacacatgcctgcgtgattgagaaagtggaactttaacagatgaaaattgtcgcaggtttaggaagtattgatgaatatgagacatttgtaaaagcgggggcggatgaattcttttgtggatatgtaccgttttcctgggcggaaaagtacggtgtgatccatccgttaaaccgtagggaagtacttttttacaatgtgcagattggttccatgagcgaactgcaaattctgaaaaaaatggtggactattatggcaagccggtagaattgacgtttaattccatctactatacaggggagcagtatcctgtcatagcggagatcatcatacagtgcatggcagcaggctttgaaaattttatcattgcagacccggcactgatgctgtacctcagacagcagaaaatcaactgcggaatccatttaagcggtgagaccgcggaagtgaaccggggaatgttagaacagatgttaccgtttggaatccgccgtgtgatttttcacagaaaaaattcgctggaagatatgcaaagttgtattaaagaggcaggtttcccacatgaatatgaagccttcattttgaatgaactctgtcatttttccggggcattctgtaattccctgcactgtgatgaactgacacatctttgcagagtaccatatgaactgggaaatctgcacaagaaagaagagacagatgctgcgcaaaaagatgtggcagaaacagacagaatacaggaaaaagaggggaagggacttcctttggatgaagatggttatctgaccggcagtaccggctgtgggctctgcgcactttaccgcatgaaacaggtcggcattacccatttaaaactggttggtcgtggcaattataccgattttatggaaaaggatataaggcagttgcggaaagctctggatattctggaaaaatcagacaatgagttgcaatatcagagggaaatgaaagcgtcactttttccggatggatgcagtcaaaactgttattatcggtgagaaaagaagatctgaggaacatttttatatatttgaacagataattattagtcatatcgataaaattcattaataataatgacttttcaggaaaagagaacctatgctatactgctatcggattataggaaaaacaggatgaaaatatatgctggcagatagaaaaagccacttttttcatactgtctggaacaaaagtaaaaataacaggagtttaaaaaatggaaaaaacaaaagagtacacatccccttatgaaatggacggaagaattccatggccgaaagcgatcgtttatggtttgcagcatgttctggcaatgtttgtcggaaacctgacaccgctgatcgtgatctgtggtgcatgcggtattggagcagcatctgactttgcagaggtttatgtggaattattacagaatgcaatgatcattgccggcgttgtcacattggttcagctttttgcaatcggtcctgtcggtggacgtgttccgatcattatgggaacgagttccggttttattggtgtatttaaaagcgttgcaggtgttatgggtggcggagtgatcgcatatggcgcgatcatgggtgcatcgatcatcggtggtctgtttgagggcgtgcttggatttttcttaaaaccgctccgcagatttttccctgctgtggtgacaggaacagtagttttatcgatcggactttccctgatcagtgttggtgtcagctcctttggaggaggatcttctgcggctgactatggttcattggaaaatttattcatcggtcttgttgtgttgatcattattcttggggtaaaacactttgcaaagggaatggcaagttcttcctccatcctgatcggtattattgcaggatatgtgttatgttttattatgggaatgatccttccgacaaccgcagtgaatgctgacggagtggaatacaccaaggcatgggttttgaattttgataaagtgagagaagcttcctggtttgcattgccgaaagtaatgccggtaaaaccgatttttgatatgcgtgcgatcgtgccggtactgatcatgtttatcgtgacagccgtggaaacgatcggtgatatttccggtgttatggaaggcggacttggacgtgaagcaacagacaaggaactttccggaggtgttatgtgtgatggacttggttcttcgcttgctgcgttatttggtgtactaccgaatacctctttcagccagaatgtcggactggttacgatgacaaaggttgtaaaccgcatggcacttgcgtgcggagcaggagtattgattctctgcggactgtttcctaagcttgcagcattgatctctattatgccgcagagtgttctcggtggagcagcagttatgatgttttcctctatcgtagtcagcggtatccagctgatcacaaaggaaaaactgaccggaagaaatattacgatcgtatctgtcgcactgggacttggttatggacttggagcaaacagtgacattttaagaatgctgccggataccatgcagttgatcttcggtggttccggaatcgttccggctgcaattgttgcactggtcttaaatattgtgcttcctaaggatgaggcttaagaagataggtaaatagaagaaaaagtgtatggataaataggatttcctttgtgagctctgcgaacaggaacatcctatttgtccatacactttttctttataacagcagtatcagaaataaacttgtgaaagcatttaaaaatagtgtataatagaaagacagagctttaaacaaaggaattaagatacatgattttaaagaagaaaattccaaatgatttttataaattattccgcacaaaaaacagggaagcatatatgcagtttgtcacagccatttacgaggaaaacaatgaagtatatgcttctctcggtcttacgcaggaagagtgtgcgcttattattgagaatacgatcgagaaatcaaagatcgtgtggcaggaagaggacgatatggaggaaggagaaacgccggatgcattatttccaagcgattctccttccggcatgttaaaccacctgatccggtggggatggctgaaaagtgattttgatgagaaactgaatacctgtgtgatctctttcccggaatacagccagttgtatgtcgagttgtttaaaaagctgcagagtgatgatgacagccgggaaagagagagcatgctttccatttacagtgcgttgtttacttatcattctgacaatgaaaaaaacaatgatattttaaaaagcgcactgcgcacatccaaaagtctggggcagctgctgtccaacatgcaggatggaatgcgttcttattttgatgagctgtcctcccagaaacattttatcgggattcagcaggtgcttgtggaggagatcaacaacagtgacagcaaaaaatatgcaatcctcacgacgacggacagtttttaccggtacaaggaggcagtgaaagaacttatcagtgaaattttaaacgaaaatgatgagaaaaaagcggtgcttctgaaagaaaaaaattctctcgaaacaggcacactattacagaagagaaatgagtacagattgcagtattgtgaggatacgagcaggatcgtgatgcagttggagcgggaatttgacatgatcgagcgcaaatacaataaactcattgagcagaaaaccgtttttgcaaagcgtgcgctggcccgcatccattacattttgcaggagggcgtcagtgaggaagataacatcatcaaactgatcaatctgttagaccgcagtgagaaaaaagatgagattttggtggaaatgagagagcgtatccgtttttcttcgcagtttaaaaatattacagataacagttttgctggaagaagagaccgcggggacggagcatttgcaccggtgatgctggacgaagaaatagacgcaagggaacagcacatgacggattttgttccaaagccgttgtatacaagaaacgagttacagagtttccgaagaaaaaataccgtggatggagtctttgtggcaacagaagagaccgtacagtctgtggaggatctggaaaaacttcttttcctctggcaggaagagacggaggaacgtctggcggaagatacggtatcggtggacggcgagatacggagtgaggacggactaacttattcgagacttgtgatcgggcagaataaataaaattgcgttactatacatgaaagaaggcattggaaaaaagatgttacaatatatggagactgtctcacagggcgaggcagaaaatatcagaaaaacgatacaggatttattccggcagacatgcattttacaggtgaaatgtgacccggcaactctggtacagcacgacaatccgaggtatcaggtgtgtctgcgccacagagagtttatcgcggactatctgtctgtgctggactgcgagcttgtgcatgatccgcaggaacatattttccggatcacgggggatggcgttatgacagagcgtatgagccttatgacaacgaagctggtcattcttttaaaaatgatttatcgtgacaaaatcatgggggaaggtctgcatgcaactactacaaatctggcagagatccgtgagtatggaaaaaatacaaaccttattacacgacgtctcacaggacaggagtggaacgatgcacttgtgctgatgaaaacgcatcagatgatcgaactgccgggagccgttgccaatctggaagattttaccccgatttatatttacagcactgtaaatgtgttctgctcggcgatggatatcaacgagctggtgcgagaataccagaatgaaatgacagaatagcaggaaatacgaaggagcatgaaatttgagccaggcaaagaaaattttcacccgtatgtgtctgaacaactggggtggaattaatcataaagtattagaatttaatgaatatgtgaatttattcagtggaaaaagcggatctggaaaatcgaccgtcatggatgcgattcaggttattttatatggaagcttcagtccgagctttttgaacaaagcggcggatgatgccaaaaaccgcagaagtgtcttaagctacctccgtggtgagcagaaagatggttctgcaaaccgtggaaactgcgatttctgttcggtcattgcactggaaatcgcggacacgggaacgcacatcaccacctgtgtgggcattgcgtttgaagtgagaaaaaatgattccgagatcaaaaagttttcctatttcagccattccggaaagatgccggaaccggggtatattacggaggaaggcttctgttattccaatcaggatatcaaaaggctggtaaatgagagagccgtatcgaaggacaaccgcggaaaaggggatgtcaaccgtatttacgcttccaaggaagcttaccttggaacgttatatgatgtcattttaggttacattgatccaaaccgttttatcacgatggaaaagagtgcgatcgcactgaaaatgacaaacggaacaggacagtttatccgtgattatatgtttccaaagagcacgtcagacacgatcggaacgatcagtgagcagttagatgcctaccgccagatcaaggaaaaaattgaggatatgcggaaacgtatcgaacttttgacagacgtaaaagagaccgggcaggagctggtgacgctccagaccgatatgatccgcgcagagagttttatccgctgcattgatattgaggatctccgggcgaaaatagaggcagccgaggaggacaaaaaaagaattgaagaagagcaggcacagctgcagcaacaggcagacacgctcgccgaagagcgcggagaggtcgaacaggagctgatccgtgtaagtgcagatttaaaagccagcgatcttggaaacaaacagcagcagttagaggaattagagcagagaagccggatgctgaccgataacagcagacagtggcgcaaaatcgttcagggattgaagcagtgggaagaggatgaggtcatcaccgattatatcagcaatccggttttaaatctcattgaagcgatcgagaacggaaatgtgacagaggaaaactgtcaggaactgcatttgaaaatagagtctgcaaagcaggatatcgaaaatgaatttgaagattacagtgagcagaagcgcgagacaggaaaagaactgaaagaaaagcagaagcttgtggatgatatgaaaaacaatcggaaatcctacagcgagaatctccgttctgcgagaagttccctggagcggaaattaagcgaccgttacggaagaacgataaaagtccagattctggcggatctttttgatgtggcagacgaagagtggaaaaatgcgatcgagggtcgtatgggaaggctgaagttttccctgattacagagccaaagtttgcgcatgatgcggcggcggtctttcgtgagatgaaacagtttgaggaagtggatctcattaattccaaagcaatcgaagacagcgagccgcgtgccatggagaactctctttatgaggcggttgagacgaaggaagcctatgtggatgtgtgcctgaaacgttatctcggtcatattataaagtgccattccgtggaagagttggagcaggtgaaagacggcgtgacaccggattgctattcctacagtaattttattttccgtcatctgcggaaaaaggattatactacaaatgcctgcatcggagagaaagtgtcaaaagcacgtctggcagagtacgaggccgatgtggagcggcttgagaaacagtatcaggaactgcattacatgaccgaacgcttaaaggcggcaagggattttgaaagcctgaaagaagaatctaaatattatgtaaacctttccggcgcggaaaaagagcttggaaaagtcaacaagaaaaagactgcgcttgaggagacaatccgcactttgaaagaggggcagtataaggaattacagcagaaagagcagagcctgaaacagcagatgcgtgagcttcaggcttcaatcagcgaaaatcagggacagatgagtgagaaaatacgccgacatgaaaatctttccggcgcaaatgaccagcgtcgtctgcagttagaggagatgctgcagggatacgtgccaaatgaggagatcgagcaggaagtgcaggagcagttaaagaagcgctccggccagtccttaaagaaccagaaaaacgcagaacttgcggctctttcggcaggagagcaggagaaagccgagacactgcgcactgccagaaaccgttacatttttgcttatccgtccagccagtttaacggttcagaaaagtccaatgaagcctatgagaagcttctggaagaatatcagacggactacgagccggcgtatgaagcggaatttgagaaacagtgtgattttatctataagagtctgcgggagaatgtgattgcaacgattcatggagatatcaaggcggcaaaacgtcacgcatacgagatcaaccgtttgctgcgtgagacgaacttctccgacagtacctaccagattaagatcgagccagcgaaaaatgagaatggtcaattctttgagatgttaatggcagaggaattagacagtaaaaatctggataatgccggttttgatggtcagttgagttttggggaggataccttttaccagaaatacgagcagaagatcaaactcctcaccgacaaattcatgccgccgagggacgaggatgagcaggtgcgtgcgaagaagcgtcaggagatggagcaatacgcagattaccgcaattatctctccttcagcatgtttgaacaggtgacagacgagcaggggaatgtcatccgtgaaaattttgtcgatgatatggctggaagagattccggcggagaggggcagaacccgaaatatgtggcacttctggcaggttttgcaatgctgtacatgcagcagagcaaccgggattccaaaatcaagctggtacttttggacgaggcattttccaagatggatcaggagcggagtgccgtctgcttaaaatatgcaagaaaaatggatcttcagctcattgtctgtgtgccggatgaacgtctgcagtcgctgatccgcaatgtggactgtgtctacggattcaggcgtcatcagaaccagatctccatgatgcatattgataagggagattatttaaaactcatggaaggtgagcatggacagggagagccggaaactgtaaaatagtgtaagaaaaccatagtcggggaggagacagcatgcagacaggaaaaggaattttaataccatctatattaaaagttggaaacggcactttgaagaaaatcggacagtatcttaagacagagaatctggaacaggtcgtgatctttttcggaaacggactgatcgacctgttcggcatggatgtcatgtattcactgaaacaggaaggaatcacggtattggagtacagcgagttggatacggtcgatatcgatgatattatcacgctggcatttgcaatgccgaataagacacaggccgtgatctcaatcggaggaggaaaagtgatcgatgccggaaaatacgcagcttttctgcgcaatatcccattcattagtgttccgacttcaagttccagtgatggattttccagcgcaagcgcatctcttctggtgcatggaaaaagaacttccgttccggcaaagctggcatatggaattattgtggatacgcaggtcataaggactgcaccggataagtttatctattcaggtattggtgatatgatctcaaagatcacagcgctttatgattggatttttgaggagaaaagcggatattcagaagtgaatgattttgcggtgatgatcgcgaaaaaggcggtgaacagttttgtgcggacaccgtatgagacgataaaagatgaactgtttttgaaagaactggtggattcgctggcaatgagcggaatcgcaaatgaaattgcaggaagcagtgcgccgacaagcggcagcgagcatctgatctcccatgcattggataaaatattagaagttccgcagcttcacggtatccaggtcggcattgcaacttatattatgagcaaagtgcaggatcaccgctatgtccgggtggagaccgtgctccgtgagacaggattctttgactatgcggcgacacttggcatgaagcgtgaagattttataaaagccatcgagatggctccgtcgatcaaaccattccgccatacttatctccatgaggaatcataccgggagcttgcaaagaagattgttttggaggatgaggtgctgcagaaggtattggtgtaaggaaaaatacattaatcgtaatgttagaacttttattttccaaaacaccaaaagaggaaaagaaaaaattctacatggttacattggtcatatggatcattttattaatctgtatgatttttatggattttcacatcataccggatacggaacctaattccataatgtatgtagtgatcatcattggaatgataaattctattgtccaaatattgcgtaaagaataaaaaggaaaagaggaaactacaatgaattttaattataacgagcaggaatatgaagaattcccaaactttaaaggcggggagaaatcgctttacgccaaaatgttccacgatgagaagaaccgcattatctacggaaaactgataccgagagcatccatcggcgtgcacacgcatgagactaacagtgagatcatctatatcacaacgggaacaggcagagttcttatggatggggaatatgagaaactggaagcgggtatgtgtcattattgtccgaagggacatacccacagtctcatgaatgacagtgatgcagaacttgaattttttgcagttgtcccggagcagaactagctttcatgattgattgcaaaggaagaaaaggaagatagcttatgacacttcaacagttaaaatatgcgttgacaatcgccgactgcggctctatgaatgaggcggcaaaacagctttttatctcacagccaagtctgtcagagacgatgaaggagcttgagacagagataggattggatatttttctgcgttcaaaccgtggaatcgtcatcacgccggagggcgaagaatttttgggatatgccagacaggtgacagagcagttcgggctgttacagtccaagtatatcgataaaaaagtaaaagagaaattcagcgtttccacacagcattatacgtttgcggtgaaagcgtttgtggagacggtcaaacagatcggtatggaacagtacgaatttgcagtgcatgagacaacgaccatcagtgtgatcgagaatgtaaaaaacttcaagagtgagattggtgtactctatgagaatgatttcaatgagaaagtcttaaataaaatgtttaaggaaaatgggctggaatttgtggagctgttttcctgcgatacatttgtatacctgtggtccggacatccgctggcaaaacaggatgtgatcacaatggaagaactggatgagtatccgtgtctttcctttgaccagggaaaaaataattccctgtatctggcggaagagatgaagagcacctatgagtataggcggctgatcaaggcaaatgacagggcaacactcttaaatctgatgatcggactgaatgcctacacgctctgctccggtattatctgtgaagatttaaacggtaacgattataaagcagttccgttaaaggaaactgagaaaatgagaatcggatatatcaaacgaaaaggcgcaaaagtcagtcatatcggggaattatacattgaagaattgaaaaagtataaggaaaaagtaatgtagatataggtacaacctataacagattcaaggtttcgcgtattaacacattttaaaaactcttgctataatggtcaatgtgaaagggagatgcaaagcacatggatcagaacagcaggagttttgtattttcaaaaagcagaagaagcagaaaggagaaccgggaatgagaacagctatttttcctgaaaacggcagaagaatgatgtcagaaatgatgtgcatgtgcagatgtatgtgtatgttttgtatgtgctgcggaaaagaaaaatgtgcgccagatgtttcgggttgaattttgcttttatagatagagcataatagacaggaatcatcttcgcgatggagcctgttatttttttgtgtaacagtcgtaaataaaaatcaataggtttttgtttttgaaaagaaaggattcgatatgtctgaaatagaagtaaaacatttgtccaagacatttgaacaaaagggtgttcatgtggatgccttaaaggatattaacctcacgatcggggcgggcgatatttacgggatcattggaatgtccggtgcaggaaaaagtactttggtacgatgcctgaactttttggaaagaccgaccgacggtcaggtgttgatcgaaggaaaagatcttggaactttaaatgagaaagaattgagaaaacagagaagcgacattgcgatgatcttccagcatttcaatcttttgatgcagaagaatgtgatcgacaatatctgtttcccattacagattcagggtgttaagaaaaaagaggcgagagccaaagccagagaactgttaaagacagtcggacttgaggaaaaagagaaggcttatccggcacagctctccggtggacagaagcagcgtgttgccattgcaagagcacttgcatccaacccgaaaatacttctctgtgacgaggcgaccagtgcacttgatccacagacgactgcttctattttggaacttttgaaaagcatcaatgagcagtttcagatcacgatcgtgatcatcacacaccagatgtccgtgatccgtgaaatctgtaaccgggtagcgatcattgaacatggagaactggtggaaaacggtctggtagaagatattttcagccatccaaagtcgaaggcagccagagaactgattttaagagatgttcctgaaaacagtggaaaagcagagggcgcagttgcagcccagatggagaggatccagggagataagaagctgcgtattgtatttacagaaaattccgcatttgagccggtgatcgctaatatgatcttacagtttggaaaaccggtcaatattttaagggcagatacaaaaaatgtcggtggtgtagccaaaggtgaaatgatcttaggcctgccggatgacagacatcttcagatcgatatggaacagtatctgacagaacatggacttgagattgaggaggtgacaggcgatgtggagtagtgaagtgacaaatatgattattaccggtatctgggaaactctttatatgacattagtatccacattggttggttatgtgatcggacttccgatgggaattatccttacggtatctgacaaagacgggattaaaccaaatgcagtattatataagattttagatgtgatcgcaaatatcgtgcggagtgtaccttttatcattttgcttgtattgctgatcccatttacaagattagtcgtaggaaagagttatggttccacggcaacaatcgttccacttgtgatcgcagcagcaccatatattgccagaatggttgaatcttctttaaaagaagtagatgccggtgtgatcgaggcagcaagatctatgggagcatccaattttacaattattacaaaagtaatgttagtggaggcaagaacatcccttttagtgggagcaacgattacattgggaacaatcttaggatattctgcaatgtcaggagcagttggcggcggcggtcttggcgctatcgcgatccgttatggatacaccagatggcagaccgatattatgatcgtcacagttatattgttgattatcttattccagatcttccagacagttggaatgaaactggcagataagtttgatcatagaaagtaaagaggagatattaaaaaaggaggattcattttatgaaaaaaagagtattatcaagtattttagcaggagttttagcagtcagcgtatttgccggatgcggaagcaaaacagaagacaacagtcaggcagcagcagataacagcacaacacctgcaacagaagcagccgcagaagagtctacagaagcaggcggcacagtagaatcaaaaggaacaattaaagtagcagcatctgcaaccccacacgcagagatcttagcagcagcaaaacctattttagctgagcagggatgggacttagaggttacagagtttgatgattatgtattaccaaacgaagttgtagagagtggcgagatggatgcaaactatttccagcacgtaccatatcttgacagtttcaacgaggagaaaggaactcacttagttgaagttggaaaaatccactacgagccattcggaatttatccgggaacaaagagcagcttagatgatatcgcagatggcgatgtgatcgcagttccaaacgataccacaaacgaagcacgtgcacttttgttattacaggataacggaatcatcacattaaaagacggtgcaggtttagaggcaacggtaaatgatatcgctgaaaatccttacaatgttgaaattcaggagcttgcagcagaatccgtagcaagagttgcagatgaagtagcatacgttgtattaaatggtaactatgcattacaggctggtttctctgtagcaaaagacgcacttgcatatgagaaatctgattctgaagcagcaaaaacatatgtaaacgttattgttgtaaaagaaggaaatgagaacaacgaaggtgtgaaagcattagttgatgtattaaaatctgatgagatcaaagattatatcaacagcacatatgacggagcagttattcctttcgaggagtaaggataataaaccggagtttaacggacgtagtgtcgcagattctgtggtgcttttatagattgtgaagggcagatataagcgtcctctcgcaagtcgtgattttatcggtttatgaaaagaaaaacggtacagacgaaatatgatgttcctgttcgccgggcattccgataagcctctaaagagtcttatctccatggctcacaaaggaaatcatatttgtctgtaccgtttttctttcatttacgctgtgaatgacttgtgagaggacgcttatacatgcccggtcaacgtcatgaattgcaccacaaaatctgtaatttacgttatggaactcccggttatgggatgagtgcctatattgggttctgccgctcgtaatccggaatgacggggtgtcgcaactgggatattgcatgctgcacagccttggataaataaaaaatagaactgatttgttttcaggattttgggagcggccggtccttagaaagcagacattgcgatttcaaaagacaatgtaattggattttgaaatcacgatggatgctttcttagtaccgctgccagcgacaacaagcggaagcgctcctgaaaacaaacagttctattttttatatttctatacactttgttggcatgcaatacaacataaccttaggaaatccgtaacaccacctgtaagcggcagttcataaattaaactccagttatcagattttgatcttcacccacttgccctgcctgaagcgcacggtcgcaaagataaatctggaaatctgatcgcccagcacgcccatccagataccgatgatcccccagccgaggacataaccacagaaataggaaatgatggtacggatgaaagtgacgcttatcatggatgcaacggctgtgtaaagcgtgtctcctgcaccacgcaggcatcccatgtagatgacctggcagatctggaaaatgacaacaaagattatgacatgtataatctggactccaattgccacaatgtggtcttccgtgaaaaacagatggtagagaccgctggcaccaaaatagtagatcgcaaccagacagacagcgatgacagcaccgatgagacgacaggtgcggccgtactctttggcaagatccggatcgccggaacctaagcttcgtccgatcagagcaactgccgttgcctgcagaccgtcgccaaacgcaaaggagagtgccataatgttcataccgacctgatgcgctgccatagcatccgtcccctgatcggcagccataatagcggttaacataaaaccgattcgcattaatacctgttcgaaaaagacactgtaagcaactttgatcagattgagaaaagcagacaaagtcgggcggatatgctgctctaatatatatggaatactcaaaaaactctcttttttgaaaatggaagcaacactcataatgcaggcaactacggtcccggatatagttgcgagtgcggcaccgcggatgccaagggcaggaaaaccaaagcgtccgttgatcagcagataatttaaaaggatattgatcgtgttggaggtcacgttggtacgcatggtgatcttcgtgtttcccgcaccgcgctgtgccgcgttaattcccatctggatgcagttgaagatcataccgcccataataatgcggaaatataccacagcatcattgtgggtgtctgccgtagaaccgcagaagtcgatgatcgcaccggcaaaaagcacaaatacaatgcttgagatgatagccgcaatcacgataaaaaggacggctgtaagcagaatctcattcgcagagtcctgcttcttttcacctcttctccgggcaacaagggctgagattgcaacatttaacgcaaaaaaaagggcaagccctaacagctttggctgtgtggtaagtccgaccgccgccacggcataggagccgagcgagctgaccattaaggagtcgatcagtccggcaaaagccacgaaaaaggactcgacaatggctggccatgccatatcaatggtgatttttaaggtctctttgtgatagtttctttttacaaattgtttttttaacaggttcattttttctccatttatgaaaaaataaataatatttacagataaaagcgcaggtagtcatacgtattcacaactgcacattatagcatgttttatgtaatcagaaaagactgcgtttttttaatctgtggctggaatctttcgttactgctcactcttgaatcactttcttatgcagcaaagcagcaagtgttttactgctgagtgaacagtaacaatcttgcttgtcagaaaatcggtagttgtatataatggttacaaggcataaatatagagcagatgcgggtaaatctattatctgcatattagatttgacaaatggcgtatcagggcatgaagcgtggaataaaagcgatttattcctgtaatgtttgatctctgctttaataaaggaaacagatatggcaaaagaattaacagaattagaaaagcattataataaatttaatgaagaaaaaaggctcggacgccgccatggacaggtggaataccgcattaccatggaatacatccaccgttatttacaggaaacgaagcatccgaaaatccttgacgtaggcgctggaaccggacggtattcggtcgcactggcaaacgaaggctatgatgtcacagcggtggaactcgtgaagtataatctcggaattttaaaatccaagggcagcagcgtgaaggcatatcagggaaacgcattgaaactgtcacggtttgcagatgaaacatttgatatgacactgcttttaggaccgatgtatcatctgtatacatttgaggataaggtaaaagcgttgtgcgaagcgaagcgtgtgacaaaaaagaacggtcttatttttgtggcatatctgatgaacgattatggtgttttgatgtatggatttaaggaaaatatggtaaaagagtgtctcggagatggcaggctgacagaagatttttactgtgtgtcaaaagaaaaagatttgtatgaatatgtcacattatcggacattgaaaaaataaatgaggcagtttctttacagcgtgaaaaaatcatagcacccgacggcgcggcaaattatatgcgtccggtcttaaaggagatggacgaagaaacatttgagctgttcgtcagataccagatgtctgtcgcagagcgcatggacttgatgggggcaagtgcccacacagtggatattttgcgtgtatcgtgaagcagacaaagattagatgaaaaattgactatgcaatattaaaatgcagattataataatggaatacgcgatcattgcagcttgtgaataaaaatgcttgtacgtgataccctaactgtgaaaacagatgtgcaatactatctgaataaacaggagggaaatggtataaaaataattattaaattgtgatataattatttttgccagaaaaaagcaaaatgggtaaaaaacaaaaaaataacagtgcatacaatggtgcgccaacggataaaaaagagactgtatacaaaaatgacacgaacgatgaatacgtttatgagaatggacagtacgagagtgcgcatggaggaaatggctaccgctatggaacgaaccgacaggtttccggtgttcataagactttgaacagggaagcacagagggagtatcatgctttggaggacgccttagagcatggaatcgcaggaaagaaaaatgccgaacaacggcatcggctggattccgaacgtgagcttatgaaatatcccaacgaattaagccagcttgcagaccgcatggcgtcggacagctggcagggataaaaaatacaaatattatatcgaggcttaacaaatgaataagaacttggaagaaatttcggacggaaaaagatatggattaaatgatatggtacgggcagcctgcaacgattgtgcaggctgttcttcgtgctgtgaggatatgggggagtcgatcatccttgatccattagatatttatgaactgacgaaaaatctgaatacaacgtttgaaaacttattaaaggagcagatagagctgcatgtggcagatggcatgatattaccgaatctgaaaatgacggataaagatgtctgtccgtttttacaagagaaaagatgcagcattcacagatttcgaccgggtatctgccgtgtttttccattggggcggatctatgaggagaacaggctggactattttttacaggtggagggctgtgtcaaagagaaccgcagtaaggtgaaggtttgcaagtggctggatacaccggaacttaagaaaaatcagcaatatctgatcgactggcatgcatttcgaaagaaaatcgaatgtattttaggggaaatgtcagatgaaaaccggaaaaagacgatcacgatgtttttgctgaatactttttacataaatccgtatgacacggagcaggatttttatccgcaattttatgcgagactggacagaattgcgcaggtgatcgcctaaatagcacaataacggcaaggagaagttatgaattacgaaggaattttgaaatttaagggaacatggcggaattatcaggcaagagttttagaacatgcagacaggtacatggcagatggaaaaatacatattgtagcagcacctggttccgggaaaacgacattgggaattgaactgatccgcaggatgaatggaaaagcactgattttagctccgtccattacgatccgggagcagtggatcgcaaggattgaggaagcttttttatgtgagggcgtgcagggggaagattttctttcacagaatttaaaacagccaaaggcaatcacggttgcaacttatcaggcattgcacagtgccatgacaagatttcagggaatgcaggaagatgcaggtgaggagagtggcacaggcacagacgagtgcctgacagaaaacgagacagaggaagtagattacagcggttttgatctggttgcggcgatgaaagaggcagggatcgaagtgctctgtctggatgaatgccaccatctgcgaagtgaatggtggaaagcattagaagatttcaaaaaacaggtggataaccttaaaatcatagcgctgacagcaacaccgccgtatgattccacaccggctatgtggacgcggtacatgaatatgtgtggagagatcgatgaggagatcacgataccggaacttgtaaaagagggaagtctctgtccgcatcaggattatgtttacttcaattatccgacaaaagaggaagaacaggaagtcagacgtttccaggaacgcagcaaagcaatgacagagaagcttatgcaggatacacagtttttcacatatgtgagaagccataaggggctgagtggacagctatcggatgacctgttgctggataatcctgcatatctggcatcgctgttgatttatttacagagcaaaaatgttgcatttccgtccaggcttcagaggctgctcggggcaaaaaaattaccttccatgaatgtacagtggatggaacgtctgttacagggatttttgtatgatgatgtggattcttacctttgtgacaaggtatatcgtgaattgttaattgcagatttaaaatccagtggtctgatagaaaagaaaaaagtcgtcatgacgaaaagtgcagcagtggaaaaaatgctcacaaattctcttggaaaatgtaacagtatccgagatattgtgttccatgagtatgagacatccggtcagaatttaaggctgctggttttgacggattacatccggaaagaatatgaaaaagcaattggaaatacagaatatgacgtaaactcgcttggagtgcttccgttttttgaaatgcttcgccgtgaaaatgaaaagaaaaacaaacaaattcgttttggagtgctttgcgggacgatcgtgatcattccggcggaggcaaaagaggcgttagagcaggagatcggaacgagtggaaaagtcacattcagcaggatcggaaatcttcctgagacagattatcttaaggtgacggctgttggaaatgcacattttctgacaggggcggtaaccaatgtcttctcaaaaggctatatgcaggtgctggtcggcacaaaatcgctgcttggggagggatgggattctccttgcatcaattccctgattcttgcaagctttgtcggttcatttatgttaagtaatcagatgcgtgggcgcgctatccgtgtgatgaaggaacagccggaaaaaacaagtaacatctggcatttagtatgcctgagaccgtgggatgaggtgctgaaggcagacgacaatcagatcagcgaagattacagtatgctggaacgaaggatggaacattttctaggtctgcattacacggaaaatacgatcgaaaatggaataaaacggctgtcaattattaaaactccatttaataaaaccaatattgacaggattaacagacaaatgctgaaaatgtcgggacagcgcgatacgctaaaaaaacgttgggacagtgcgcttgcaatctatgacaaaatggatattgtggatgagacagaggtgaaagacaagtttgtgacgagtgttgttttctgggatgcgattctcacaatgatcctgtcagcaattttattcctgatcggggcaattggggcaggtgtcgtggcgggagcgtcccgaaatggacatttagccggaatctgctatttcttcattgttgtcggactgactggaatcatgatacgttttccgaaaattttcatgctgtggagtccgttaaaaagattaaaggcatttggaaatggaatccgtaaagcgctggaggagcagcagcttctggaagaaacacactgcaaagtagtggcagaatcgccgggaccggataaccatatcatttatctgtccggtggaagcggcagggataaagcgttgtttgcgcagtgtgtcaatgagttttttgatgtgatcgacaaccagcgttatatacttgtgaaaaagaaggggcggaaaggactgaacggtttctatgccattccaaattgcttttcgaaaaagaaggaggatgcggaatgtttcgcaaaatgcatgcatccgtatattggaggctatgactgtgtgtatacaagaaatgaaaaaggaagggaacttctgttagaaggcagggtaaaggcacttgccaatcgggaggaacgttgtatttcccataaaaaagtaaaaggggcattggagtaagatgacgcaggacaaactccggtcaggagtttgtcttactgaaaaatgcaacgcagattccgccgggaccggtatgggttccgattgtgcttccaatggaactgataggcagttcttccacataagatttccagagatcggtgttatcttctatgtatttttgcagaagggaatcttctaatccggtataaccgagacaaagcggcatggagaaatcaataccattgcattttgcaatttcctcccggagcatattgcaaccgttttttgagccgcgagcttttccaagaactgcaacctctccgtcggcaattgtgatcaccggtttaatggagagcagatttccggcaagagcggcagtcttggaaatgcgtccgccgcgttttaaatattctaaggtatctaataacgccagaacgcggacatctttctttttctgatccagagcttttgcaatttcagaggcagaagcaccgacatctctgagacggcaggcatacatcacaagaatctgttcgccaagacatacattttcgctgtcaacgatcgtaatacaatcttcataaccatccaatgcaatattggcactctgaaaagtaccggaaagcctggaggaaagtgtgatgacaactgctgtgtcttttttttctttcacatctgcataaagctgctcgaaatcatgtggcggaatctggcttgtggtcggcatacagtcactctcgatcagtttttcataaaattgctggtggcttaatgtgatgccatccagatattcttccgtaccaaaaattgttttcaaaggtaaaaaatcaagtcctaatttatctgcctgttcctttgtcagatcagaggcagagtctattataattcgtacactcatcataatctccatttcaaaaatattatttttgacttcaaacattgtgaaatccgttctgaacaatgaaatagtttagccagaaaatttattttgttaaaatgctttgagaatcaaactattataaacaatagacgaaatgaaatagaatgtcaatagtattttgataatcaaactaaatggaacgcattgaataattatgaaacaatccattcatactaatcataaaattgcttcgcaaaacaaggaggatttatgaattcattatggacggaaaatatagaaatgccggagttcccgactttggaaaaggacatccggacacaggttttgatcattggcggtggtatggcgggtgttttgtgcgcctattttttacagcaggcgggtgttgattactgtctgttggaaaaagaccgcatctgtcagggcgtgaccgggcatacaactgcaaaaattacggcgcagcacggattgatttacgaaaaatcattacagtccatgggacaggagcgtgcagaactgtttctgaaagcaaatttaagagcggtggaaaattataaaaatctggggcgttttctggattgtgacatggaagagacagattcttatctgtattctgtcagggagcgtcggaagttagagagtgaaatacaggcattgggcagtcttggatttcaggctgattatacggaggacacggagttaccgtttgaagtggagggagcaatacggtttccgcggcaggcgcagttccagccactcaaatttgccgccgggatcagcaaaaatctgagaatctatgaacattccgaagtgcgtgagatgacagagtattttgcattgacagaaaaaggttcagtcgcagcagagaaaattatcattgcgacacattttccgtttattaatacgagaggttcctattatttaaagttatatcagaatcgttcttatgtacttgcctgtgcatatggaaaaaatctgaagggcatgtatcttgaagcagataatatcggattgtccctgagaaattacgaagactatctgctgataggcggaggcggtcaccggtctggaaaggaaaaaaacaactgggatttactgcgcgatatcgcaaaggaatatttcccggaagcaaaggaacgctatttctgggcaacacaggactgcatgtctctggataaaagaccatacatcggtccatacagtaaaaatacaccggatctatttgtggcaaccggatttggaaaatgggggatgacaggttccatgctgtcagcaatgatcttgtcagacctcatacaggaaaaaaacaatgaatattctactgttttttcaccatcacgcaatatgttaaaaccacagttaatttctaatctgggtcatgcacttgtggggattggaagggttggcggaaaaagatgcagtcatatgggatgtgtccttcagtggaataaagaagaacagacatgggaatgtccatgtcatggctcaagattttcagcagatgggaaggtgttggataacccagcctgtgatggactaaaaaagaaacataaaaaataggtattgagattcaaaataagcagtggtatgatacaaaaccggaataaaaacaaaggagaaaaatcatgaaatatgtaagacagcttttaattattctgttcgtttctttttttggtgaacttttaaaatatatcataccactatccataccggcgagtatttatggcatggtacttcttttccttgcattggaattgaaaattttaaaggtgtcagacatcaaagaaacaagtaattttctgatcgagatcatgccattgatgtttgtgccggccggagtaggacttcttgattcgtggggagctctgcagccaatctggatacaggtggttgtcattacgctgatctcaacggtgatcgtcatgggagtttccggaagcatcacgcagtttgtgatacgaaaaggaaagaaaaaggaggagtaagaacatgaaatcatttttaacagattccgttttcttaggggttgtagtcagtctgttgacctatgagtttggtttatggtttaaaaagaaagtaaaaatcgcaatatttaatccacttttaatttctgtaattgcagttatggtatttctggtggtgtttcatatagactatgcagattatcaggaaggagcaaaatacataagttatctgttgacgccggcgactgtctgtctggcagttcctctgtatgagcagtttgagttactcaggaaaaatctgaaagctgtcatagcaggaattatttccggggtatttaccagcatgacatgtattctggttctggctttgcttttccgtttcgatcatcagcagtatgttacattacttccaaaatctatcacaacagcgatcggaatgggagtttctgaggaacttggtggctatgtgacaattactgttgcggtcattatcatcacaggaatttttggatacataacagcagatgcggtattaaaactttttcatattgaagaacctatcgcaaaagggatcgcaattggttctgcctcccatgctgtaggaactgcaaaagcgatggaactcggcgagatagagggggcaatgagcagcctttccattgcggtttccggtattctgaccgttgttgccgctatggtttatgctaatttgttataaaattaaatttgctgtctgtctgtgactatgtcagatatatttctccaaaaacagggaaaatgtgcaaggattatggaaaaacttacaaaaaaatttattcggtgcaataaaaacatctatttgtgcattaatagagtgaaaggagtgaaatgatgatactttttgccttgacgtcggacattaagcaatcaacagactatgcagatttggacagtctgctttacggcatttccaacggtgacaagaagtgcctggagcagctgtatcaggttacgcacacatctgtttacagttttgccctttcggttttgaaaaaccaccacgatgcagaggatgttctccatgactgttacgttgctgtatggaatggagcagaaagctatgtttcccggggaaaaccgatggcatggattataaccattgcaaaaaatctgtgtttgcagcggatgagggagcgcaagaaagcggaatgtacatcgcaggaaggctgggaacttgctatcccggatactgatatgctcacaatggaggacagaagtattctcgtcacctgcatggaacaattgtccgatgaggaacggcagatagtgatgcttcatgcggcggtcggatttaaacacagggaaattgccaggattatggaacttccgctgtcgacggtactttcaaaatatgcacgagccttaaaaaggctgaaacaatatttgcaataggaggtggcagcaatgacaaatgacgaattgaatgagaaaatccggcaggcatgtactcacgcagcaccggatgtgttggatgctgttctttccgactgcaatgagcagaaaggacgagtgatattgatgacgacagaaaacaagaaaaaaacatgggcagttcgaatggcaggtttggctgccggtttgtgcctgatccttggaggtggattgggagtcaggaattatcaggtcaatcatacggtagatgctacggtttcgctggacgtaaacccgagcgtggagattaagatcaatcagaaggaacgtatattggatgtgattccgctgaacgaggatggcagaaccattgtcggtgacatggatttctcaggcagcagtcttgatgttgcagtgaatgccataatcggttcgatgcttcaaaacggctatctcaatgagctggccaattccgttttgatcagtgtggacaataatgatccggttcggggcatggcattgcaggaacggctggcggacgaagtcaataaactgcttcagaccgattcattcagaggggctgtattgagtcagacggttgtaaagagtgatgagctccagcagatggcagaacaatatgggattacgctcggaaaggcacaactgattcaggagattctcggcaaaaactctttacacacatttgatgaacttgctccattgtccatcaatgaactgaatattctgctggggaaggaaggggcagaaacccatgttgaggttgttggaacggccagtgaaaagggatatatcggggagacaaaggccaaagagatcgcactggcaaaggcgggtgtatctgagagcgacctgacattttatacagttggactggacacgcataagggagtcatggtctatgatgtagaatttatttcgggcagttacgaatttgactgtgaggttaacgcaatgaccggtgaaatcgtaaaatttgaaaaagaatacgatggcgctgctgtttcaaatgtatcggttgaagagcacggggagcagtcggagcacagtcagacggaagaaaaccaggctgtcagcaatatttcactggaaaaggccaaggagaccgcactggatcatgcaggggtaaaagctacagatgcgacttttgtaaaagcaaaaagtgactatgaagatggacgtgctgtttttgagattgagtttgttgtttcttccggcaataccatcaaggagtatgattatgagattgctgcatctgacggaagtatcataagctatgactacgacattgaaggagatagtacacctacagcaatacaagcaggcagcagtcagaatacaagtgaaatttcactggaaaaggccaaggagattgctttatcccatgccggtgttgcaagtgccaatgcttttgagatggagggaaaactggattgggatgatggcatgtctatttatgagattgaatttaaagctggaggctatgagtacaactatgaagttgatgcagccacaggatcgattgtcgaattcgataaggagtgggatgattaagtgattccaattcggtaaccaaacccgcagaatttcataaaataatctgaaaatatttttatggaagaaaatatgtattgtcagaatcgaatcagttatcgtgtacaggaaggagactctctgtacaaacttgcaaaacagtttcatacaaccgtaaccgaacttatcctgctcaattccggggtgaacccatacaatcttcagacgggaatgcgcctgacgatctgcccgggagagggatatgtggatgagaatgagagcaaaccatccgaggggaacacgaacaaaccaactaagactcctgtgggtggaattgtcattatcccgggaactacgacacagccgggaggcacaacacgcccgggaactacggtacagccgggaggcacaacacgcccgggaactacgacacagccgggaactgcaacacgcccgggaaccacaacgcagccgggaaacaacatgggcgtggatctgcgacagcgcatgcgcatggcatggctcaatcatattacacttgtaaaattctatctcatcagtttttttgaaaacctgtcaggtcagaatgcgtggaaagacgccgtgtacaaaaatgcagaggagattcttgcgatttttgctcagtattatccagcttcagcaatgcagagattccgcaaactttttatggagcatttgcgtctgaccgatgaagttgcagccggcttaaaggctgatccggctttttcgggagcagctatggaaaactggtatatcaatgcggaggaaatcgcatcctttttgagcagacagacaccggcctacaacgagacagagttgagaaaaatgttctacgatcatcttgatatggaacgtcagcagatggaagcatatctggacggcgattatgagacagatattgaaatttacttaagatcacagcagaatatgatcgagctcgccgattttcttacaagtggacttcttgcgcggtaaatcgtaacaatcatattattacttctgattttaagtgccataatcataaattataagtggttgacataattctaagtaagaacgcagaaaagccgaaaaaccgctttattttaagaaaaatagtttgacgaaatttgcatttatgataagatatagtcgttagtcctgaccgggaaaaagaaaaactgcaatcaggaaagtgacggctggctgtgatcggccggtgataatagagaaacagaatcgaaggagtttgaaaaaatgattaaagttgtgaaattcggtggaagctctcttgcaagtgcagaacagtttgcaaaggttggtaagattatccatgcagacaaagagagaagatatgtagtgcctagtgcaccgggaaaaagaaattctaaggacacaaaggtaacggatatgctgtatgcatgttatgaccttgtggaaaaggatgaagatttccgtgtgatgttaatgaaaatcaaagaccgttatgacacaattattaatggtttgaatttaaaactttctttagaggaagaatttaagaaaatctccgagaattttaaaaataaagcaggtgttgattatgcagcgtcccgcggtgagtatctgaatggtatcattatggcaaactaccttggatatgaatttgtggatgcggcagaagtgatcttttttgatgaggatggcaactttatgccggagaaaacagataaagtactgtctgagcgtcttgcaaaaacagagcgtgcggtcattccgggattttacggcgccaaagaggatggaaccatcaaaacattttcacgtggaggttctgatatcacaggatctatcgtttcgagggcagtgcgggcaacctgttatgagaactggaccgatgtctccggatttttgatcgcagatccaaggatcatcgacaatccaaagccgatcaagacgatcacttaccgtgaactccgcgagctctcctacatgggagccggcgtactgcatgaggatgcggtattccctgtgcgcaaagctggtataccgatcaatatccgtaatacgaatgcaccggaagatgagggaacctggatcgtggagagcacctgccatcagtcaaaatatacgatcaccggtatcgcaggtaaaaaaggtttcgtttctgtaaacattgataaagatatgatgaactccgagattggatttggcagaaaagtgttatctgcatttgaagataatggaatttcatttgaacatatgccatccggaattgatacaatgacaatctttgtacaccagccggagtttgagggaaaagagcaggctgtcatttcggctatccacagatatgcgcagccggacagcattgagctggagagcgatcttgcactcattgcagttgttggccgtggtatgaaatccacacgcggaacagcaggaagaattttctctgcattggcacatgcaaacatcaatgtaaaaatgatcgatcagggatcatctgagttaaacatcattattggtgtaagcaacgcagatttcgagaatgcgatcaaggcgatttatgatatttttgttatcacacagttataggataaatgaaaaaacaaactacttttcgtaagacaattgaaaaagtatggaagaatagggctgcaatcgttatcgcaattgcagccactgtttttatgtgcggattgacggcgctggagtttgtggcgcttcggatggaatggaatcttccggtgcttgcgtatgtgacaggtgattctgacagctatatttttgaggaatacagaagtgatgagatgaaactggatgaaagcacggaaaacgtaatgttagaagaggatatgctgcaaggcgaaagtcagagcgaaaattccgggaaagatatcacacagggtgaaagccagagtgaggatgatattgtgccaggagaaggaaagaacgagaatgttcggcaggaagatacagtgcagggcgaaaatcagcaggaaaaagattcgcagcagtctgcttcagatgaagcggaatttccatattacataaaagtaaatcgcagacaaaactgtattaccgtatatacttcagacgaaaacggcgaatatacggttccgtataaggcgatgatctgttccacaggattgtacaatgcaacaccgcgcggcacatttcatttatcaaccaaatatctgtggcgggaactgtacggaaaagtatatggtcagtatgcaacccggatcacaggaggcgttttgtttcattcggttccatactataaaaaatcaaaaagtgctctgtgcacagaaaaatataataaacttggacagcaggcatctatgggatgtgtgcggcttacggtggaagatgcaaaatggatcgcagataactgtccatcgggaacaaccgtggaaatttatgaggatgatgatccgggaccattgggaaaacctgaggcagcgcatattgatacagacagtccgaataaaggctgggatccgacagatccggatgtagagaatccgtggcatcagctgtcagatgatgaataaaaaataaacatgaaaaaggcgacatcgaaattttttttctttcaatgccgccttttaaactatttcgtccatgggactatacctcgctattcttttttctactgttcgttctgtttgccgcttcattttgaaatttctaaacaatttttcttattgcctatcatttcttttatgaaactctcaaacaactcttttggacttcttcgcttttctcttcaatctctgaacctgttttcttatgacatttggaattgtatcatataagaatgtttctgatctgatactaattcaggattcctttcttaggatcgtcatgttttcatttcatcttttgaaggtaaaaccgaatgcaattactgttttggtggactgtacctcgattcttttaaaattcttttgggtaaatcgttatgtttctggtggtccgtacctcctgtctttcatattctattaggtatttcgttacgtttctggtggactgtacctcctttatttttttctctcttgttttttgttaatttagttataacagataaaatagaaaatgtcaataataaaattagaaaaatataaaaagatttataaagataaaaataattatattaattttgcgaaatattcagaaaatataaaaagcataaaaaatataagcaggaacgaaaaatccatatgcaggacaactttgcaaaacatcagatgggaaggaaccgggaaacatttctttcatataataaaatgaagggagcgtaggtgtgaaggatatgaacggtcaaacaatacttcttataagcgatatgcgtcaggtatatctggcagaaatcctgacaaaaaaagggatgagtgtgcgctgcctggacatcagaaacagtcagacagtagaagaacagcttttaaaattaaaaaaatttcttgccggggcggcaatgctggtgcttccgatcccggtaaccaaagttccagagcaggagcggctgaatgaaattttaaataaaaatctggcaaatgatacgctggtgcttggtggatgttttacagaagaacagcgggaacttttggacaggagaggaatccgttaccttgattttatggaggatgaagtggtgacacaggaaaatgcggtggcaacggcagagggtgcgatcgcagaacttaccaaccacagtccttataatatagaaggtgccaaaattctggtgaccggatacggaaactgtggaaaggcgatcgcaaagaaactccggggactgggagcgagggtgacagtgcttgccagacgccgcgaggtaagaaagcaggcaaaagaagatggattttatgcagttgattttgcattcggaccggaggaggcaatgggagcggcaatgcttgtaaatactgtgccggcaccggttgtgacgcgggtaatcatcaaggaacttccgcgtgatgcctatattctggatattgcctcaaaacctggcggaacagattttgcatgtgcaaaagagtttggcatccgggcagatttagtgcttggaattccgggaaaatatgcgccgaaagaaagtgcatatatccttgaacgatccatggaacgttttgccgcaaagcaaaaaagcatagacagatagattcgtttttacagaaaatgtgtgacagaaaatataggtaatgaaatgattcttgatttaaatagagcaggaaggtatggaaaatggatttttcaaaatgtaatatcggacttggaatcacaggttccttctgtatgttttcaagagccagaaaggaaatagaaaggctgacagaacttggcgcaaatgtgattcctattttttcatttaatgcacagacctgtgataccaggtttggaagcgcaaaagattatgtggaagggatctgtgatatcacagggaatgagggaatacgcactatctgcgcagcggagccgatcggaccgaataattttctggatatcatggtgatcgcaccgtgtaccggaaatactgcggcaaaactctgcaacgggatcacagatacaccggttcttatggcagccaaggcacacatgagaaatggaaagccgcttgtgatctcgatttccacgaatgatgcacttggagcgaattttaaaaatatcggtatgcttatgaatacgaaaaatgtgtattttgttccgtttgggcaggataactgtaagagtaagccaaattccctggtcgccaaaatggaattgctgccggagaccattgagtatgctttgaatggcaaacagattcagccggtcattcagaatccggattaaaccggagtttcacttaccgtggagcagcagattttgtggtgctttcttagggtgtgaagggcagatataagcgtcctctcacaagtcgtgatcttataggtttatgaaaagaaaaacggtacagacgaaatatgatgttcctgttcgccgggcatttcgctgggcttctgaacaacaatcatgttcagctgaagcttccatgattgttagaatcccagctccatggttcacaaaggaaatcatatttgtctgtaccgtttttctttcatttacgttacgaatgacttgtgagaggacgtttatacatgcccaatttatgctatgaagcgcaccacagaatctgcaatttacgttatggaactcacggttattggaggagtgcctataagataaggtcaaaactcaatctgcatccttgaaataaatgaattaggacttctttaaataaattttaatagaataaaatagaatgatttgtttactaaagaattgtatacttgaaattgacaaatctctttgagcgagggatacttcttgtccgaatggtaagaatatggaactgaaaagaataaaaacaatatggctttgaacgaaataatacattttttcttgacaacctaacaattgttagataaaatgcatctaacaactgttaggtgaaaggagacgctatggaaacaaaagaacttattttaaaaaaggcgttggatatgtttgctaaatcaggttatgattctgtatcaataagagatattgcaaaagctgtgaatataaaagaaagctctatttactatcatttcaaaaataaacaagatattttagactcacttgtagaaaagtttgagagccatatgaaagaacttacagatatgttgcaggcatcaatgtctgattcacataatgttaacgcattttcatgggattggctacgggagttttattttgaacaatatttatttgatacattttgtaatcaaatgatgcgctttatgatgatcgaacaatttcataacgaaaatatgagaatgttgtatgaacgttatctatttgaactccctcataaaattcaaacacaatcatttatgatgcttagcaagcttggaattttgagtgaacaacaagcaataaaagttagtaatgatttttttgcaagtattacaatgcttacatttaaatatttattaaatgggaaattgacaaaaacaaaaaaagaagcttttagtgaagaaactttcacatatatcaatagaatgtttcaggaggattgaatatgtcaaatatattaattgtaggcgccaatcggggcattggttattacatggcaattcgtttactggaaaagggaaacaacgtgacggttttggacattcaagacgaccacataagtgaattaaaaaagaggtatcagaattctcttctcattatcagatcggatgcaacagatgaggattcattatcagagggcataaaaaaatcaatcaaagaatttggaaatgtagatatagcaattcacaatgcgtgcctttgtacgtttgctaatgagcaagatacaggttacgaagtatacaaaaaagtaatggatgtcaattattttggagcattaagactttcaaaattaattctcccatttatgcgtgagaagaaagagggtagaatcatatttaccagttccggtgttggggttacaggcttcggtaatatatcaccttatgcgtcttcaaaaggtgcaatagaatctcttgccaaatgtcttgagattgaaaaccaagattatggaataacattccatattatgcacccgccacttacaaatacagcatcttcttcagaacttcccgtacccaaagaatttatggccgatgctgaaaaaataggaaagggacttgctgatcatgtttggtcaaagaaattcgtaatctgtcattctttcagtcaatcattacaaatgaaattatgttattgttatccgctctatatgggaaaaatgatgtggaaaatgacgcagagagcaattagaagataagttgtgaaaacccgtcattctagattacgtgcggcagaacccaatataggcactcatcccctgaccgtgagttccataacgtaaattgcagattttgtggtgcgattcatgatgttgattgggcaaatataagcgtcctctcgcaagtcattcgtaacgtaaatgaaagaaaaacggtgcagacaaatatgatttccttcgtgagccatggagataagactctttagaggcttatcggaatgtccggcgaacaggaacatcatatttcgtctgtaccgtttttcttttcataaacctataaaatcacgacttgcgagaggacgcttatatctgcccttcaagccctgagaaagcaccacagaatctgcgacactatgctagtgaaactccggtttatttctgctctgcttcataggcttcgcgacaggctttggcaagctggtctccgcaggaagttccgcgtccgttgcaggaaattccaccgattttctgttctacctgctcaacggtaagaccttccacaagctttggaattgcctgaagatttccattacatccaccggtgaattttacattgtgaacaatatttccctctaattccaactcgatcagagtggaacatgtaccttttgttttgtatacatacttcataatatatgcagacctcctcttttgatgatacgattccatacattatatatcatcccggaagtgttcgacaagttctttttttggaaaatcaaaataccccggatgttataccggggcatgagttagttgtttatattgttaaagtcgatacataaatctggatagattcctacgttaatcgtatctgagaatgagtattcgtcaatatccccatgttccagatcgtatacagtaatccgttttttgtctggatcaacaatccagtattcacgaacaccagcagtacggtatttgaatagttttgtgtaatagtccattcgtctgctgccagatgatactatttctataatccaatctggtgcaccattgcagcctttatctgtgagtttggatttgtcgcagatgacgcttatatccggttcaacataatttttatcatctgcatttagaaaaacggcaaatggagcgatatatggctcacacgaaccccctcttgattttatataggtgttaatgatggtaaagagattgccggctataagctgatgtctgcgtgtgggtggagccatgtaatagatttgaccatcgatcagttcggcgcgttccccatccgggaggttataaatatcatctgtagtatagattctttcctgtggtaaagtcattagaacaccacctttcataaataataggggataagagtatcttcatcatcttgcaatagaattatagcttataattaaaaatatgtacataatataaaaaaataaagatatctgtttgtggagggttactgttggcttagcagtaaaacacttgctgttttgctgcggaggatggcaattaaattacgtatacataaatccgacaggatatttttcagttaataaaaaattcacaaatcgtttacgcctatttttgttgtggtgaagcctaaaaagtgttacaatagcgataccgtgcgaggtttctgcataaatgacagaaatttttcaaataacagagccgggacaggaataggagtttttatgggagcattgacaaaaatcttcgggacacacagcgagagagagctgaaaagaatctatccgcttgttgacaaagtagagtcttatcgtgactctatgcagaaactttccgatgaagaattaagaaacaaaacaaaagaatataaagagcgtctggaaaagggcgagactttggatgaccttttgccggaagcatttgcaacggttcgtgaagcagcaaaacgtgtgctcggcatggagcattaccgcgtacagattatcggtggtatcattcttcaccagggacgtattgcagagatgaagaccggtgaaggtaagacacttgtttctacactgcctgcatacctgaatgcactggaaggcaaaggtgtctgcatcgtaaccgtcaatgattaccttgcgaaacgagattctgagtggatgggacaggttcatgaattccttggactgaaagtcggtgtcgtgttaaattccatgacgaacgatgagcgcagggaagcatataactgcgatattacttatgttacaaataacgaacttggtttcgattatctgagagataacatggtgatctacaaagagcagcttgttcagcgtggattgcattatgccatcatcgatgaggtcgactcagtattgatcgacgaggcgagaacaccgctgatcatttccggtcagagtggtaaatccaccaagctatatgaagcgtgcgatattctcgcaacacagttaaaacgtggtgaggatgtgccggagtactccaagatggatgccatcatgggtattgaacaggaagagacaggagactttgttgtcaacgagaaggacaaagttgtcaacctgacacaggaaggtgtgaaaaaggttgagcagttcttcaagatcgataaccttgcagatgcagagaaccttgagatccagcacaatgtgatccttgctctgagagcacataatctgatgttccgcgatcaggactatgtggtaaaagataacgaggtcatgatcgttgatgaatttaccggacgtattatgccgggacgccgttattcagacggacttcatcaggcaatcgaagcgaaagagcatgtaaaagtaaaacgtgagagcaagacgcttgcaacgatcacattccagaacttcttcaacaaatttgacaaaaaggctggtatgactggtacagcactcacagaggaaaaggagttccgtgatatttacggtatggacgttattgaaatcccgaccaataaaccggttcagcgtatcgatcatcatgatgccgtatataagaccaagaaagaaaaatatcgtgcagttgtcgaggaagtgaagaaggcacatgagaaaggacagccggtactggttggtacgatcaacattgatacttctgagttactcagcggcatgttaaaaagagagggaattcctcatactgtattaaatgcgaagttccacgaactggaggctgagatcgtagcaggtgccggacagcatggagcagttacgatcgcgacaaacatggcaggccgtggtacggatattaagcttgatgacgacgcaagagcagcaggcggtttaaagatcattggtacggaacgtcatgaatcaagacgtattgacaatcagctccgcggtcgttccggacgtcagggagatgtgggagaatcacagttcttcatttcacttgaagatgatctgatgagactctttggctctgataaactgatggatgtgttcaatgcacttggtgttccggaaaatgaacagatccagcacaagatgcttacctctgccatcgagaaagcacagcagaagattgaggctaataactacggaatccgaaagaatctgttggagtacgatcaggttatgaatgatcagagagagattatttacaaagagcgtctgcgcgtgttaaatggagagagcatgagagatgcgattttcaagatgatcacagaccgcgtagagagttgtgtggacacctgtatttcttctgagattccaaaagatgagtgggatttaaatgaactgaatcagttactgcttcctatcattcctctggaacctataacggaagaaacgattactgatatcaggaataacaaggaacttaagcatctcctgaaagagaaagcagtgaagttatatgaagcaaaagagacagagttccctgaaccggaacagttccgtgagttagagcgagttgtcttattgaaagtgattgaccaaaaatggatggatcacattgatgacatggatcagcttcgtcagggtatcggacttcaggcatatggacagagagatccgcttgttgagtacaagatggcaggattcgatatgtttgatgagatgacagccaatattcaggaagatacgatccgcctgttatatcatgtgaagattgaacagaaagtagaacgtgagcaggttgcaaaagtaaccggaacgaacaaggatgattcagctcctgctgaaccgaagaaacgtgcagcagcaaagatttatccaaacgatccgtgtccatgcggctctggaaagaaatacaaacagtgctgtggaagatttgcagaatagaaataaaatgtgcagagcatttagattcacaagagtctgaatgctctgtttttatacatataaaaagaacgagtgttcgaataaactatatacaaatcgatggaaatgtgttatattcttaaaagatatttacttgtatattccaattgaaattacatcatactatggtgtcggaaaattgatttcaatgaaatttttactataaaccccggaggtgacttttgtgcaaaatgaacaacaaatattcaaactacatgccccataccaacccaccggtgaccagccgcaggcgatcgaagaactggtaaaaggcttcaaggaaggcaatcagttcgagactttgcttggtgtgaccggttccggtaagacctttacaatggcgaacgtcatcgcacagcttaataagccaacgttgatcatttcgcacaataagacactggcggctcagctttacggtgagttcaaggagtttttcccggagaatgcagtggaatactttgtttcctattacgattattatcagccggaggcatatgtgccacagacggacacttatattgccaaggattctgcgatcaatgaggagattgataaattgcgtttgtctgccacggcggcactcgtagagcgtaaagatgtgatcgtgatcgcctcggtttcctgtatctatggtctgggcagcccggaggactaccttggaatgatggtttctctgcgtccgggaatggagaaggacagagatgaggtcatccgtgcactggtcgatatccagtacacaagaaatgacatggattttcaccgtggtacattccgtgtgcgcggtgacacggtagagatttttccggcaaactacagtgatacggcaatccgggtggaatttttcggagatgagattgaccggatcaccgagatcgatgtgctgacaggggaagtcaagtgcagtctggaacattttgcagtttttcctgcttcacactatgttgttccgatggaaaagattcagaaggcttgtgtgaatatcgaagcagaaatggaagagcgcgtaaagtatttcaagggagaggacaagctgctggaggcacagcgtatcgcagagagaaccaattttgacattgagatgttgaaagaaacaggattctgcagtggtattgaaaattattcaagacatcttgcaggacttccggcgggagcaacgccacatacattaatggactattttaaggacgacttcctgatcattgtggatgagtcgcatatcacgattccacagatcggaggaatgtatgcgggtgaccagtccagaaaatcaacgcttgttgattacggattcagacttccttctgcaaaagataacagacctttgaattttgaagagtttgagagtaaaattgaccagatgctttttgtttccgcgacaccaaatacgtatgaagatgagcatgagttactccgtgcagagcagattatccggccaaccggtctgcttgatcctgaggtggtagtccggccggtagagggacagattgatgatctgatcggagaagtgaataaagagacggcaaagaagcataaggttttgatcacaactctgaccaaaagaatggcagaagatctgacggactatatgaaagaactcggtatccgtgtaaaatatctgcattcggatattgatactctggaacgtgcagagattatccgtgacctgcgtctggatgtgtttgatgttctggttggaattaatctgctccgggaaggactggatattccggagatcacacttgtggcgattctggatgcagacaaagagggattcttacgttctgagacatccctgatccagaccattggacgtgcggcgcgtaacagcgagggacatgtcatcatgtatgcggataagattaccgattccatgcgcaatgcgatcgacgagacagaacggcgacgcaggatccagcaggaatataataaagaacacaacatcacgccgaaaacaattcagaagtctgtccgtgatctgatcagtgtatctaagaaagtggcacaggaggaactgaacttcaagaaagatccggagtccatgaacaaggaggaactgacgaagctgatcgcagatattcagaagaaaatgcagagagcagcggcagatctgaacttcgaggcggcagcagaataccgcgaccagatgctgcaattgaaaacaatgcttcaggatttataataaggtggaagggcaattgcttaataaaatatagaagggtgcagatatatgaaaacatcagagaaccgcaaatacatcaagatacgcggtgcgaatgaacataatttgaagaatattgatgtggatattccgagagatgaatttgttgtgctgaccggactttccggttccggtaaatcatctcttgcgtttgacacaatttatgcggagggacagagacggtatatggagtcattgtcctcctatgcaagacagtttttaggacagatggaaaaaccaaatgttgagaaaatcgaagggctttctccggcaatttccatcgatcagaaatccacaaaccggaatccgaggtcaacggtcggaacggtcacggagatctacgactatttccggctgctttatgcaaggatcggagtaccacattgtccaaagtgtggaaaagagatcaaaaaacagacggtcgatcagatggtcgatcagatcatggagctgccggagcgtactaagatccagcttttagcaccggtggtcagaggaagaaaaggggagcatcagaagttttttgagcaggcaaagcgaagcggttatgtccgtgtcgttgtagatggaaatctctatgaactgtctgaggagatcaagttagagaagaataaaaagcacaacatcgagattgttgtggatcgtcttatggtaaaaccggggatcgaaaaacgactgacagattccattgagaatgtactgcagctggcagatggattgatgatcgtggatgtgatcgatggagaaccaattcagttttctgagagtttttcatgcccggactgcggtatcagtattgatgaagtggagccgagaagcttctctttcaacaatccgtttggtgcgtgtccgacctgctttggacttggatataaaatggagtttgacattgatctgatgatcccggataagaggttgagcatttcggagggggcaatccaggtgatgggctggcagtcctgcactgataagagcagcttcacctatgcgattttaaaagcgctgacggaagaatatcatttttcactggatacaccgttccgggaatatccggatgagataaaagatgttttgatcaatggaacacacggaaaagaactgaaagtacgctataaaggacagcgcggtgagggcgtgtatgatgtcgcatttgacggtctgatccgcaatgtgcagagaagataccgtgagacttcctctgagacgatgaaagcagagtatgaacagtttatgcgtatcacgccgtgtgaagcctgccatggacagcgtctgaaaccggaatccctcgcagtaacggttgcggacaaaaatattaatgagatgacctccatgtcggtgaagaatcttaagacatttgtagatcagatggaactcacaaagcagcagcatctgatcggcgacccgattttaaaagaaatccgtgcaagagtgggatttttaaatgaggttggactggattatctgtcattgtcgagagcgacaggaacactgtccggtggtgaggcacagcgtatccgtcttgcaacccagattggttccggtcttgtgggagttgcctatattctggacgaaccgtcgatcggactgcaccaaagagacaacgataagcttctgggggcattgatgaatttaagagaccttggcaacacgctgatcgttgtggaacatgacgaggatacgatgagggcggcggactacattgtggatatcggaccgggagccggctcacatggtggacaagtggttgcgtgcggcactgcagaagagatcatgcagaacccggattctgtcacaggggcatatctgagcggaagaatccagatcccggttccaaaggagcgcagaaaaccgacaggctttctaacgatcaagggcgcaagggaaaataatttaaaaaatatcgacgtggatattccgttgggcgttatgacctgcattaccggtgtttcgggttctggaaagagttcgctgacaaatgagattttgtacaaacatctggcgagggatttaaaccgtgcaaggtgcattccgggagaacatgacgatatccttggactggagcagctggacaaggtgattgatattgaccagtctccgatcggcagaacgccgcgttcaaatccggcgacttataccggtgtcttcgatatgatccgcgatctttttgcgggaacaccggatgcaaaggcaaaaggatataaaaaaggacgtttcagcttcaatgtgaaaggcggacgatgtgaggcatgctcaggggatggaattatcaaaattgagatgcatttcctgccggatgtctatgtgccttgtgaagtgtgcgaaggaaagcggtataacagagaaacacttgaagtaaaatataaaggaaaaaacatttatgatgtgctggatatgacagtggaggaagcattggagttctttaagaacgtgccgtccattgaacgcaagatccagactttatatgatgtgggactttcctatgtaaaacttggacagccatctacggaactgtccggtggtgaagcacagcgtatcaaacttgcaacagaactcagcaagcgcagcacaggtaagaccatttacattttggatgagccgacaacaggacttcatttcgcagatgtgcacaaattgatcgagattctgcgcagactttcagatggaggtaataccgtagtcgtcattgagcacaatctggatgtgatcaagactgctgattatatcatcgatatgggaccggaaggtggagacggcggcggaactgtgatcgccaaaggaacaccggaggaagttgccaaagtgaaaggatcctataccggacagtatgtaaaaaaatatcttaagaagtaaatagcaggatgtacgcttagcgtacattctgctgcaatggacagagatgtgatacactgcagatttgcggtcgtcataacaaaaaaggtgtctcgcatgagacaccttaaaatttcggggagtgctcctccgatatccgtagatatcgaagaagcatgagttatgaaaaattatattagccgacttaataagtcatattagctagtactattataatataaaaagaaaatgtgaccattttgtgatgaaaaaataaaaaaaatcttatgaagcatcatttattaaaaaaatcttatttttcttgaaaaataggattttctggaaaaaaaactttgaaaaatataactttttgtatataataagattgtatatgtaaaaataggagtagtatcgtacttcttattttaatagtgcagaagaaaaaagtgatttttaatgtatttccgtatatctcatacaggaaaatattgacatacattccaaacaattccagaaaggggaatatcataattatgatgagtacagatattggtatcgatctgggtaccgcaagtatattagtatatatcaagggcaaaggggttgtattaaaagaaccgtctgttgtcgcttttgaccgtgatacaaataaaatcaaagccattggggaagaggcgagattaatgctcggcagaacaccgggtaatattgttgctgtaagaccactccgtcagggcgttatctcggattatacagttacggagaagatgatcaaatatttcattcagaaggctcttggcaagaaaacattccgcaagccaagaatcagtgtctgcgtgccaagtggtgtgacagaggttgagaagaaagccgttgaggatgcgacctatcaggcaggagcaagagaggtttctattattgaggagccgatcgcagcagctatcggagccggaattgatattgcaagaccttgtggtaatatgatcgtagatatcggtggcggtacagcagatatcgctgtcatttctctgggcggttcagttgtgagtacttcagtcaagatcgccggggatgattttgacgaggcaatcgtccgctatatgagaaagaaacacaatcttctgatcggtgagcggaccgcagaggatatcaagattaagattggaacatgtttcccattagcacagaatgagacgatggatgtgcgtggacgtaatctggtgacaggtcttccaaagacagtaacggtctcttcagaggagacagaggaagcgctgcgcgagcctactttgcagatcgtcgaggcagtacactctgtattggagaaaactccaccggagcttgctgccgatgttgcagaccgcggtatcgtacttaccggcggcggtgcattgcttcgcggtctggaagaactgatcgaggacaggaccggaatcaatactatgacagcagatgatccaatgacatgtgttgcgattggtacaggaaaatatgtagaatttttatctggaaaacgtgatgacgattaagctaatatttctgtcagatcgaccgaaatacaatattggataaaacgtgactgacaggtggatatacaacgattgatgcgaggtgtaatatatgatcaaaggcttatatacagcatatacaggtatggtgaatgaacagaagagattagatgttctcacgaataatctggcaaatgcagacacaaatggctataaaaaagaagggacaacatctcagacgtttgcggatgaactggcaattaagataaaggatacctcttcttatggcctgaataaaaaacttggtgtgatcagtatgggtgtgcaccttggtgagacttataccaattatgatcagggaagtatcaaagtgacggacaatgagacagatgtggcattggctggaaatggattttttgcaattgcttttacgaataaagcaggggaaacttctgtgaagtatacaagagatggagcttttaccgtgaatacagagggttatctggtgacaaaggatggcgattatgtgttgaatcaggcgggtgcacagaataccgatccgaatgcaaggatccggttaaatccgaatgcgaagattaccattgatgagttagggaatatttatcagaatgaccagcttgttacaagaataggcgtcgttgattttgatgattataattatatttccaagtatggtgagaatctgtatgatcttgtggatggaggacagatcacagcttctgatgcaaaggtgcagcaggggtgtatcgaaggctctaatgtgaacgttgtggatgagatggtaaagatgatcactatctcaagagcttatcaggcaggacagaaagtgatcaatacggtagacgagacattggacaagaccgtaaatcaggtgggaaaagtataatataaggtacaggtggaggaaatcagactatgatgagagcactttatactgcagcttccggaatgagagcgcagcagaccaacgtagataatatttcaaataacattgcgaatgtcaatacaacagcatttaaatcccagaagacagagtttaaatcactgttatatcagaccattcagaccagaacgacaagtgcaaatggtgaggaaaaaccaatcggagcgcaggtgggacttggaacaagagttgcgtccaacaccacaagctatacgcagggtgcgctgctcgaggatgagagcaaatctgcttttgcaatcgaaggaaatggattctttcaggtgagaggggcagatgggacaacttactataccagaaatggtaattttaactggagtattggtccgacaggaacaacccttaccaataccgatggatatccggttctggattccaatggaaacaccattgttcttccgaataatgtcaattctgagaaggcggtagtgacaacggatggtcaggttggctattataacaatgcgggtgcttatgtaagtatgaaccggacaattggcctcagccagtttaacaatcctgcaggcttggaaaaagcaggatctaatcttttgagagcgacaaatgcatccggggcagcacttaatgaagcaaccaatgcgaacctcacaagaagtaaaatccatcagggttatctggaaggctcaaatgtacaggtagcagatgagatggtaaatctgatcgtggcacagcgtgcatatcagttaaactcaaaagcgatcacaacatccgatgatatgttagagcaggcaaataacctgaaacgttagttttttacattctacaggaggctgaaaaaatatgagtatgtcaattgacagcatggcatccatgctgaatacgaccaatacagatgcaacaaccaattacaatgccaatgcattgaaaaaatcattaaacggtgtatcttccgacacatctgcggatgaactgatgcaggtttgcaaagattttgaatcttatttcgtagaagaagtcataaaagaggtaaaaaagaatttactcccggatgatgaggagaaagatgcatcattatccacaatgacagattatacgatggattttgcagtggaaaagattgcagacgaactcattgatcaggttggtggtaactttacacagtcattgtatgagcagatgaaacgtaattataatattgattgatcagagtacatagaacgataccattcatagcaggactcagacagtgtctggtatgaatgacagaaattaagaatcacaggctgtcgctttaagagattatttcttaatgcggcagctttttactttacgaatcatttggtttcagatagaaagaaatggattagaaagttatggagaaattagcaggatatgtggagcatatcatataccgcaatacggacaatggttatacagtactcaatctggtgagcggcgaggatgagatcacctgtgtcggcattttttcgacgatcgcagaaggggaaaatattgaggcgactggcgattataccgatcatccgacgtatggcacacaatttaaagtggtgagctttgaagagaaggcgccggaagatcaggaggcgatcgaacgctaccttggatcgggtgcgatcaagggaatcgggcttgcaatggcagcccgtattgtgcggaggtttagggaagatacattccggatcattgaggaagaaccggagcggcttgcggaagtaaaaggaatcagcgagcggaaggcaatggagattgcaagtcaggtaaatgaaaagcgagacctgcggcaggcgatgatctttttacagcagtttggaattactatgaatcttgcggtaaaaatttataataaatatggacaggaagtgtatggaatcttaaaagagaatccgtaccggctggcagatgatatcgagggagttggtttccggacagcggacgatattgcagcaaaggcaggaatacggacggattctgatttccgtgtgcgaagcggtatattgtatacactgcttcaggcgtccggtgaggggcatacctttttgccacaggaggaactgacagcaaaaacaagtgaattgttgggaatcgacaaagatatcatcgaaaaaaattatatggatctgtcaattgaacggaaaatcattatgaagcagtcgggagagcagacgcagatttattcagcttctttttattatatggaagcaaatacggcaacaatgctccgggaactggatattgcctatgatgtggcagatgcagagatagagcagcggatccataacattgagaaacagacaggaatgcagttggatgaacatcaggtgcaggcggtaaaagaggcggtacgaaacggtcttttggtcatcacaggtggtccgggtacaggtaagacaactacgatcaatacgatcatccgatattttgagatggaaggcatggacatttttctggcagcgccaacaggacgtgccgcaaaaagaatgagtgagacaaccggatttgaagcgcggacgattcaccgcatgctggaattaaatggtggtatggaaggaagtgccggatttgaacgtaatgaaacgaatccattggaaacagaccttgtgattattgatgagatgtcaatggttgacataacactgatgaattctcttttaaaagcgatcgcaccgggaaccagactgatccttgtaggagatatcaaccagcttccaagtgtcggaccgggaagcgtgttaaaggacatcatccagtcggaagcatttaatgtggttatgctgacaaaaattttccgtcaggcgtcgacaagtgacatcattgtgaatgcacataagatcaatcgtggggaagaggtttccctggataataaaagcatggatttcttttttctgaagcgatatgaggcagatatcatcatcaatgtggtacttcagttagtaaagcagaaaatgccgaaattcgtggatgcaacaccgtatgatattcaggtgcttacacctatgcggaaaggtcttctgggggtggaacgactgaatgggatcctccagcagtatctcaatccgccggataaatcaaagcgggaaaaagagcatggcgatatggtattccgtgagggtgataaagtcatgcagaccaagaacaactatcaattggagtgggaaatccgcacgaaatttggtctcactgtggataaaggaatgggaatcttcaacggtgatatgggaatcattacagagatcaatgattttgcagagacgatgaccgtggaatttgacgagggaagaaaagtagagtattcttacaagcttctggatgagctggaacttgcctacgccattaccattcataaatcacagggaagcgaatatccggctgttgtgatccctctgctcagtggaccatcaatgcttatgaaccggaatctgttatatacggctgtgacgagggcaagaaaatgcgtcacactcgttggaaatgatacaaccttcaatcagatgatccagaacacgtcacagcagaaacgctatagtggactgtgcgaccgcatccgtgaaagcgtgttgtaaaccggagtttaacggacgtagtgttgcagattctgcggtgctttcttagggcttgaagggcagatataagtgacctctcacaagtcgtgatcttataggtttatgaaaagaaaaacggtacagacgaaatatgatgttcctgctcgccgggcattccgacaagcctctgaagagtcttgtctccatggctcacaaaggaaatcatatttgtctgtaccgtttttctttcatttacgctgtgaatgacttgtgagaggacgcttatatttgcccaatcaacgttatggattgcacaacagaatctgcaatttacgttatggaactccggttatgggatgagtgcctataggatcaaaactcaatctgcattcttgaaataaatgaattaggtttttttaatgaattttaacggaataaaatagaattgcatatgtgattatggtagaatatgatattaatgattttgtcaatcggaatttttaggagaaaacgatgaagaaatggacaaaaatattgttgataatagttatagttattttacttttgtttgtgggaatgtcctattttatagggacgcaagttttcatggggtctactcaattggttacttgtgaagatacttcaaaagtgaaagatagtttttgggaaagatataatatggattatgatgttttctgcagtacatatactatagaaaaagttgaaatcacttcaacttttgatgaacatatgataccggcagattacatatatgctcttggtgaagaaggagataagaataatccaacagttattttagtgcatggtcttggtggaaatcgttataccaattatcctttagcagaaatgtttttgcagaaaggatataatgtattgacttatgaccagagaagtagcaacgaaaatacagctcaatatactacatttggatactgggaaaaatatgatttgattgattacattgattatgtctatagccatgcaccggagcaagtgataggaatatggggtacatcgtttggtggagcaactgcaggattagcaatgggagataaggatgtggaaaacaaagtggattttctgattctagattgtccggttagtgatatgaaatggatggtagaagaagaaatgagaaagatggatattggattgcctatatcttacatgacattctgtggcaacattatcaacaaaatggaattgggatttagttatgatgatgcaaatgtatgtgacaaaattgcagatattgaaattccggttttggtaataaacagtgaagcggatacattaaccccacagtttatgggacaagaaatatatgattcaatacaaaatgaagaaattaaaatgatttggacggtaactgatagtgaacatacagaaatatggttagatcacaaccaagaatatcgagaaaaggttcaagaattattgaattttactaaataatagaaatagggaaagtaaactttgaatttgtctgcgaaaagcccataaataagcggatgttaatatgtattgcttgtggcaacggctcttttgaatatagaattgagctatcaaaaacaaggaggcagagattatgctaaatgaaaatatcaaaagaattagaaagtcaaaagggctgtcgcaagaagaactggcaattaaactgaacgtagtaagacagacagtatcaaaatgggagaatggtttgtcagttccagattccagtatgctgattattttggcgaatgaactagatactactgtaagtgaattacttggagaacctatagcagaaccgactaccgatgatttaaagattctttctgaaaaattggaagttattaatttgcagcttacaaaaagaagtataacaaaggtaaaaacgattcgatggattcttatttcattgtgtgcggttatagtggtaatatttatcgcacttgcatctacgaatagtttttatttggattggaattacaatgatcctgagttggcagtggcaggaacaatactgcatgggtttgaattcttgtttgtaagactcgcaccgattgttttttggacttcggtggttggaattgtggtgacatataagaaaagataaatttcagttagcaggtttgttcgccatgccgacagactcacaagctggcacttgttcgttgttgcggcgttcgccgtatgcatctgaactcgaatatgtctgcctgtgagcaagctcccgtcagccaattcagttcatctgcgcatggcccattgctatgcgcaaaatcccaatttgaggaggtgaacactttggatattgagaaaaccgaatcatattacaatcaaataagaaatgaagatttatgtgattgtgattattgtagaaacaatattcatgaagtcaaagcagcttatcctacctcttttatagacactccataaccgtgagttccataacgtaaattgcagattttgtggtgcaatccataacgttgattgggcatgtataagcgtcctctcacaagtcatccataacgtaaatgaaagaaaaacggtacagacaaatatgatttcctttgtgagccatggagacaagactcttcagaggcttgtcggaatgcccggcgaacaggaacatcatatttcgtctgtaccgtttttcttttcataaacctataaaatcaagacttgtgagagaatgcttatatctgcccttcaagccctgagaaagcaccacagaatctgcgacactacgccaattaacctccggttatgataacaaggccttgtcgttagcaaattcctgcccgctgactttttcaaactggtgcagcagatcttcaactgtcagtttcttcttttcctcgccggaaatatttaagataacttttccttcgtgcatcatgatcaggcgatttccgtgcacaatagcatccttcatattgtgcgttaccatcatagcggtcagatgattgtcggagataatcttgtcggaaatctcaagtacttttgcagccgttttcggatcaagggcagcggtgtgttcatctaacagtaaaagttttggtttctggatggaagccatcaacagtgtgattgcctgacgctgtccaccggaaagcagcccgactttgctggtaagacgatcttcaagacctaaatccaatgtttttaacatttcccggtaggtgtcgcgttctgccttcgtgattccccagcttaacccacgctttctgccacggcgggctgcaattgccatattttcctcgatggacatggtggttgcagttccggtcataggatcctggaagacacggcctaaatatttggcgcgtttgtattcggataattttgtgacatcatcaccgccaataaatattttgccggaatccactggccagacacctgcgacagcgtttaaagttgtggattttccagcaccgttaccaccgataacagtgacaaaatcgccatcttctaatgtcagatcaactccgtttaaagcaattttttcattgatcgtaccagcgttaaatgttttgcagatatgatcgatttttaacatttcagccattattttgccactcctttcctgctatatttcgctttcagatacgggattgaaaggaagatagctactacaattgcagagaataatttcaggtcatcggatgggaatttcaaccataaaacaacacttaaaacaaggtagtacaggatagctccggcaatgacggagagcagtgtgtaagcaaatgcaatttttttgccggcacacatttttccaaagaggacatcgccaatgataacagcagcaagtccgataacgatcgcaccacgtcccatattgacatccgctgctccctgatactgggcgtaaagtccaccggaaagtcctacaagaccgttagagatcatcagtgcaagtacggtatgaaaatcagtgttgattccctgcgctcttgccatctgccggttacagccggttgcacggatcgcatgtccctgctctgttccgaaataccagtagagaatggcaacgagtacaacgcagaagaggatacaggtcgtaaacatacggattttgcttgcagttgagtccgaaatataacggagtgaaacaacaaggctgtatttgtcaacgctgactgcctgattggaacttccgagaatatttaagttgatagagtaaagtgaaatctgcgtcaggatacttgcaaggattcccgggatcccaagtgcggtatgtaacattccggtgataaatccggcggccattcctgcaagaaaagcaaagataagagcaagccatgggttcatgcctgcgcggatcagcataacggcgactgcacctccggtcgccatggaaccgtcaacggtcagatcggcaaaatccaataatttgtaagtaatgtagactccaagtgcaaggagtccccagatgagtccctgtgcgcatgcgcccggcagggaacggagcaatgccagcgggctcagggaagctaaataagttgttaacatcatcgtcataagaaatctctccttatttttttataaaatgcctgtgcggaactatttggtgcaaaaattatctacaaatataaaataatattcatgaaatcaattgcttgcagaacaaaatacccacagcataaaatacctgcggtatttgttgagacgaaataccgcaggcatattataacataatactaaaacgatttaaagctttaacttgttgcattgatgaaagattattctgtttcaattgcaacataatcatcaggaggtgtgattccaagctgggaacaaatatctgcattgtactcttttgttacctgtggtgcagtcttgatctccatcgttgtgatatcagcaccgtttacaaggatatcataagccatctggcctgctgtgtatccgatatcatagtagctgatagaaagcgttgcaacaccacatccggaacagatgccttcctcaccggcaatgatcggaatacctgccggaagagcgatgttattgatggtttccgtgttgtttgccattgtgttgtctgttggaatataaataacatctacttctgaaactgctgtctgtaccacagaggtgatatcattggaatcagaagcagtatattctttgtacgcaatgccgtcagcatctaaagcagcctcgatctgggtagcctgatacttggagtttggctctgcggaacagtaaaggataccgactgtttttacatccgggaataattctttgatcatggcttcctgttcatctaaaggagcaagatcggaagttccggagatatttcttccggtagaacctgtccagtcgtcgatctcaagggcagttgcataatctgtgacagaagttccaaggatcgggatcgtgcttgtagcagcggcagaacactgtaaagcagtggttgcgtttgcaaggatcaggtcatagttgccggcaacaaaattatttgcaatggtagcacagtttgcctgctcgccctgtgcgttctgaaggtcaaatgttacattatctgcaccgagcagctctgtcagtgcatcctcaaagccctgggaagcagcgtcaagagcagggtgctctaactgctgtaaaataccgatcgtatatttctgaccatcggtactgcctgctgcagcggattctgttgttgctgctgaattgtcagcagatgcagaggtattgtcggaggctgtatcgccgccgcatgctgtcatggaaactgtcattgcagctgccatcatgacagagagtattttgttcatctttttcatattcattctccttatcattgatcatagcctttaatgctttaaagcattaatacttttaatgattgaattataatcactcatacaggattcgtcaaccggaatttgagaaaaaatgtgtaaaggacactcattttttcggtgaggatcataagaaaaagatttaaaatcttaagaaaacctttatagtatgcagggcagaaaagtgttaggatggaaaccggagagatttttagaaaggattttatgaaaataaaagaggggttatccaacattgtatttcctccaagatgccctgtctgtgatgaggtgatatatgttgggaaagatacctgtgaagactgccggaagaaagtgatctgtatcggggaaccgtcctgcaaaaaatgtggcaagccattagaagaccagaggagggaatactgcacagactgcatgaggaaaaaacactatttttcccagggaaaagcggtttttgtttatcagggagaaatccgccaggccatgtaccgttttaaatatagtaataaacgcgaatatgcagatttttatgcgaaagaagcagtgcgcatctatggagactggatccggagaaaacagatcgaagcaattgtacccgttcccatgtaccgtttgaaggaaaaggggagagggtataatcaggcagccgtatttgcgcggactctgggagaaaaaatgaatcttccggtggaaaagcgcatggtaaaacgaatccggaataccacgccgcaaaaagaattaaatgatgtcgaacggaagataaatctaaaaaaagctttccagttagtaccaaatatagtaaaatataggaaaatattaattgtagatgatatctatacgacgggaagcacgatcgatgcagtggcagaggtacttttgcaggcaggggtggatgagatttatttcctatgtatcagtatcggcgagggattttaggaggaatatgctatggatgtaagaaattgtaagggctgtggaaaactctttaattatatgagtggcgcacagctttgccctgaatgcagggcaaagcttgagaagaaatttagcagcgtgaaagattatatcggtgaacatccacaggcatccatcagtcaggtggcagaggatatggatgtttctgtgaaacagatcaaacagtgggtgaaagaggagagactgatcctctcggaagcttctttagatggtgtgttgtgtgaacactgtggcagaccgatcacaagcggacgcttctgtgacaagtgtaaagctgctatggcaaataatctgcggagtgctttgaacagaccacgtccaatgcagcagagatcgggcggagagcgtgatgaaggggataagatgagattcctgagatagaaccgggaacagaatgtcacatatctgaaaataaggacagaatttataaaaaagcagggcgcatagctacgttatttatatagatagaaacgtagaaaggtcgcatctgcttttttttgtttgaaaataccgcctactgtgttataatgatgaataagaatgcataattgcgtgaagaatgtactttttcagaaaatgagatgggtttattttatagtagatacattgtgtgacagacaggaaggaaatctgcatggttaacgaagaacgtttacatcatatgataaaaatggcgatatttgacaccaatcagggaaaagaatgtaagccgatgacacagtatgcaagaaaagattatgtttcgctgcgtatgcttggaagctttgtgtcaggaacgattggctttgcgctgatccttgtgacatggggcatttattccatgaaccagttaatggagaatctgaatgcaatggatattcagaaactgctgacatccgtgctggtaaagtatattgtgtttatgcttgcttacatggcgatcacgtattttgtttataatagaagatatacaaagggacgccgtgaggtaaagaagtattatggcaatctgaagaagctgaatcagttatacgagagggaagacaagctgaaaatgtctgagaataaagactgggaataatacctgaacactgccgggagcaggaaaatcaggagtaaaacaaacggcgggaggctaaaatgacaaccttattagaattgaaagagaaactgatccgtttttacggaaaaaatgaaatatatgtgaaaccggcgatccggtttgtacttgcattgtttacattccttatgatcaacaacagtattggatatatgaaactggtcagcaagacaccggttgcagtcattcttgcacttgtgtgttccatgcttccggtcaatggactgatcgcaattgctgcgttggtcgttttggcggatctgtatgcattatccattgaggtgtgtctggtaggacttctcatgtttgcgatcatctattttatttatttccgtttttccccaaagagtggtatcaatgcggttctgacaccggtctgctttaagctgcatattccttatgcggtaccggttggctccggtctgctgagtgaggcgtattctgtagtgtctgttgcctgcggtacggtgatctatttctttatccatggagtgagcgagaatgcaagcgcattgagcgatgcagcggaagagacggattcttcggtatcaaaagtagtagtggcattgaaccagctgattggaaataaagagatgtaccttgttcttggcatttttatcattacgacactcattgtctatgtggtgagaaagcttgacattgagcattcatggacggttgcatgggcatccggtattttatttgaagcgattggactgacagcaggatacattttacttgggatttcagacaaaattgccggtgtgatcattggaagcgtgatctccggtgtgatcgccatgatcatccagtttctgttttttaatctggattactccagaacggaacgactccagttcgaggatgatgattactattattatgtaaaagcagttccaaagtctctggtgacagagaaggataaacagatcaaacgttttaacggcaaaaacgagaaggaacgtttgaacaagaagaaatttgcagaagagatggacatagacgaaaatttattagattaaaaggaagtgaatccggtgcagaatttaggcgtaatattgcggacgttttgggaaaaagcggtgtcttacctgacacttcagatgtccctcacagatattatagagatcattatcatttcagttctgatctattatatgctggtttggatcaaagatacgagagcgtggatgcttctccgtggaatccttgtgatccttgcctttgttttgcttgcagttttatttgaaatgaatacgatcgtctggatcgccgacaaactgtttaacgtggcaatgatcgctgtggtcgtgatcttccagccggagatgcgcaaggcactggaaaatctcggacggaagaacattttggtaaatctttttaattttgatttcaacaaagtggagaatgggaagttttccgacaagactatcacagagctggtgaaagcctgctatgagatgggaaaagtaaaaacaggagcactcatcgtagtggaagatgaaatcgttctgacggagtatgagaggacagggattgccgtagatggtatcctgaccagccagcttctgatcaatatttttgaaaaaaacacaccgctgcatgatggagcagtcattgtgaggggagacagagttgtttctgccacctgctatcttccactgacggactccttaagcctgagcaaagaccttggaacaagacaccgtgcggcagtcggtatcagtgaggtgagcgattcactcacaattgtagtatcggaggaaaccggaaaagtatccattgcactggacggtgaactttaccggaatgtagatgcagaattcttaaaaaataaactggcttacattcagaaacgtgagcaggacacttcgaaagtgaaatcatggagaaggaggctgaaagatgttacaaaaattcggaaagaaagtaatgaataactttggccttaaaatccttgctgttttgtttgctgttgttttatggatcgtagtcgtgaatattgatgatccgagcaactcaaaaccttacacaaccagtgtctcactggaaaataaatcttatatcacctccatgggaaaatgggcagattatctggatggaaagaatacgatcacgttcagcgtgtatgcaaaacgctctgtgcataatacacttaccaatgcgaactttacagcaacggcggatgcacagaaaattgaatatgatgagaaaacagggacttaccgtgtgccggttgtcgtgacctgtaaccgtaacaacagcagtattaatattaccagcaaagatctgtatctggatcttgaactggaggattctgcttctaagcagttcccaatcaagacaaacacaaccggtacagttgcgtcgggatgtgcgcttggtgatgttgagatcacagatgcgaatgttatgaaagtatccggtccggcttctgtggtaaatcagatcgataccgttgtggcgactattaatgtagatggcatgtcaacggatatcacagaccgtgtgacacctgtattttatgatgcacagggagaggttgtggatacgacaaagcttacgctgagtgtgagcacagtcaatatcagtgcacagatcctgaatacgaaagatgtggaactggaattcctgacaaccggaactccggcagatggataccaggcagggaatatcacctatacaccacagaaagtacgtattaaaggcgaggcggctattttaaataccatcaataagatcacgattccggaagaagtgttagatattacagatgcaacttcaaatattgaaaagactgtggacatttccacatatcttccttcaggcactgcattagtgatcagttcagactccaagattgatgttacagttgtggtggaggcagtaaagacaaagactttgcagatcccggtgacgaatcttcaggtgatcggactgagttcggatgaaaaagtacagtatgaggaagacaacattgccttgacagtgtcaggaagaagcagtgtgatcgatgcgctggacgaaaagacgatttccggcagtatcgatctgacagatttaaagctgggtgcacataatgtactgattacatttgaattggatacaaatacggtcagctatgcggatacctatgccgcggttaccattgaaagcgcatctgatacatcagcttctgctgataatacagatgaggaactggagagtacctcaacggtaaggaaaacaagtgaacgttagcagatttaaaaaatttgaaataggaacaaagagaggaacagtaatatggcaagaatgtttggaacagacggcgtccgtggtgtggctggctcggaactgacaattgaactggcaacaaagttaggtcaggcaggagcttacgtgctcacaaaagagcaggagcatcaggcaaccattattgtaggatgtgatacgagaatttcaggaggaatgttagcgagcgcattaatggcaggtatctgttcggttggcgcaaatgcaatatttgtcggagtgatgccgacacctgcgatcgcatatctcaccagaaaacacaaagtagatgccggagtagtcatctccgcatcacacaatccaatggaatttaatgggatcaagttcttcaatggagagggctacaagcttccggatgagatggaagatgagattgaggctctgatcaaaaataacatgaaagacgtggtacttccgatcggttctggcgtaggaaagattgattaccgctttgacctgagagatgaatacgtgaaattcatggaaaaatgtgttccggtggatcttaaaggtatgaaaattgttgtagactgcgcagaaggcgcatcccattatacatctgtcaaagcactgacagatcttggagcagatcttatcgcaatccatactgatccggatggaaccaacatcaattccaattgtggctccactcatatggatgagctgaaagcgcgtgttgtatatgaaaaggcagcagttggtcttgcatttgacggtgacgcagaccgtatgcttgcagtggatgagcatggaaatgttgtggacggcgatcagatcatggcaatctgtggcaactacatgaagtccaaaggaactttgaagaaagataccattgtagttacggttatgacaaaccttggatttacccttatgggacagaaagagggcatccatgtggaaaagacaaaagtcggtgaccgttatgttcttgagaatatgagaaaaaatggctataacatcggaggagaacagtccggccacgtgatcttcttagacgataatacaaccggtgacggattattaagtgccctgcatttattagaagttatggtcaataccggaaagccattgtcagaacttgcggagattatggaagtactcccacaggctcttgtcaacgcaaaagttccaaaccataaaaaagaaaaattcatggaatatcaggaaattgcagatgccgtggcagatgttgagaaaaaattcaagggcgagggaagggttctcatccgcccatccggaacagagccgctggtgcgtgtcatgatcgaggggaaagatcagaaagtgatcgatgaagaagcaaggaaactggcggaattgatcacaaaaattatgttataaaataccaaaatgctggtctgattataacatggtgattcagaccggcatacggataaaaaatcaggggactggaatttggagggtaatacagcatggttagtcagaaagtagtaataaaaaatccaacaggactgcatttgagacctgcgggaattttatgtaaggatgcaatgcagtttaaatcacatatcacgttccgctaccgcgataatatcgcaaacgcaaaaagtgtcttaagcgtgttaggcgcatgtatcaagtccggagatgagattgaactcatatgcgagggcgaagacgaggaagaggctttaaaagcgatcgtggaagcgattgaggatggattgggagagtaagggatattttttcaaaaattaaaagaaaaagatattaagtaagatatgaaaataagcattattataccggtatacaactcaactttatatttgaaacaatgtgtggaaagcatattggcgcagacgtatcacaatttcgaaattttgttagtagatgatggatctacggatgatagtccgatgatatgtgatgaatatgccaaaaaagatgatagaattgttacgattcacaaacagaacggtggaacatcagatgcaagaaacgtcggattggagaaagccagtggtgattacatcacatttatggacaatgatgattattggagtgatccagatgcgttgtgtgatatcataaaagtgataagtgagacagaaccggatgttgtgatgcacgcaaacatggtgtattggcaggataaaaatagaactgtaaaaccgtcttcttttgatcgcacacttgtatcgggaaagaaaagaaaagaggcagtggaaaatctgataaaagctggaatgcttagcgttacagtttggacaaaacttgtaaaaacctctttgatacgggaacatgatctgtattttaaaaagggaatccgcaatgaagatacagactggattgccagaatgctgatttacgcagaacggtttgaatggtatgataaaccattttatgtgtaccgcaaaggccatgaaacagctcagacaagtcagaagatgaaatattatatggtgaatgatctgaaaaatattataatagaatatacccaatatgcagaaaaatatttggatcaagaatatcggaaagttttttatgcgtatttagcttatccgtttgcagtctggatgggacaggcatatttgatagaacaggatgagcaaattaaaaatgatcgtgagataatgaaaaaatatgcatatctgttaacttatgatataaacccggcagttcatctggttcatagggtatatcgtatattaggatttggattgacatcaagaattttaatgttatatattaaaaaagtttattattcataataaaaaaatacattagagtaattgaacaggtgaaaaaaatgtcaaaacattattgcattttttctgcacagtattatccgcatgttggtggtgtagaacgttatactttgtatttgagcagaaaattgatcgctgcaggaaacgaagttactatagtaacatcaaatacgggtgatttatcaggagatgaaatacaagaaggaatccagatttatcgtctgccatgttacgatttattaggcggaagatatccggtgttcaaaagaaacaaagaatttaaaaaagtaaaaaaactgatcgagaggaatcaatatgatcttgtgattattaatacgagattctatctgcattcattatatggtgcgaaatttgctaaaagtaaggggattccatccattgtaatagaacatggaacatcccacctgagtgtgaataataagttgtttgacacagtggggggatggtatgagcatttccttacatttttgttgaaaaagtattgtgatgattactatggagtttcggaagcctgttgtgagtggagcggacatttccatatcaaatcaaagggaacactatataatgcggttgaaatcgaagaatttcagcggattttaaaagagtctgacattgattatcggaaggaatatgagattccgaatgaagcaaaagtaatttcttttactggcagattaattccggaaaaaggaattaaacagcttgtatcagcggtaaaaaagataaatataagcaggacaaaaaaaggacaggcaccagtttatttaatgattgcaggggatggtatattatatcaggaattgatagaaatgtcagatccgtatatcatattgaccggacaagttgattttgaacatattgttaaaattttggatgcgtcagatatattttgcctgccatcggattcggaaggttttccaacttctgtcctggaggctgtggcatgtaagtgttttgtgataacaacctatcaggggggagcgaaagagttacttgtagatgaacagtatggaattatcatgagagataatacagttgaatcaattcagaaaaatttggaaaaagtaatagaagatgatgcataccgaacacaggcagaatgtaaaagttatgatagattagtaaaatatttcacgtgggatgccactgctgaaaaggttatgcagattgcaaaagacatgaatggagagaaagaatgaaagtattgatcatcattccggcatacaacgaacaggacaatatagaacgtgtggtgaagcatttgacggaaaattatccagagtatgattatgtggtgattaatgatggatcaatggataaaacatctgagatatgccattcaaatcattacaatattatagatcttccggtaaatttaggacttgcaggtggatttcagactggtatgaaatatgcatatcaaaagggatatgattgcgcagtacagtttgatgcagatggacagcacagaccggaatatattgcagcaatgatccggaaaatagaagaaggaaatgatattgtgatcgcatccagatttgttgaagaaaagaaaccggctacagcaaggatgattggaagcagattgatcaccactgcgatcagacttacttcaggtgcaaaaatcatggatccgacatctggaatgcgtatgtataataaaaaattaatagaagtattggcaaacaacataaattttggaccggaaccggatactgtatcgtatttgattaaaatgggagcaaaagtggcagaaatacaggcaaagatggatgaaagaattgccggacaaagttatcttaatgccgtcaatgctgcaaaatatatggccagaatgttgatctctatattattaatacagaactttcgcaataaaaagaaagtggattttacaaaatagacaggataaaggagaaaagaatgtcgatagcatttcgaattacattgattatcgtatctgtttttacattgctttatatgtgcaaaaaagtaaaacaggaaaaattacagatagagtattctattttttggacattgtttgcgataatgctcgttttgtttagtatttttccacagattgcagattggatgtcagagttggtaggcgtatattccacaactaatttcatatttcttttgattatatttatattacttgtcaaatgttttcaacttactatggacatttctaaactggacaataaagtaaaagaattagtacagaagattgcaattgatgagaaagaaaaaagggaacagaaataaatgaaggaaacaacagcaaagaagaaatttatgtggaatatggctggaagtctttgcaattcactttcctctatgcttctgttgattatcgttaaccggattagcggagagagcagaggtggattttttgcattggcgtattctacagcgcagcttttgttttctgtcggtggatttgaaatcagaccagttcagtcgacggatataaaaaataaatttacatttgatcaatattttaccagcagaatgttaaattgtattattatgctgatctgcatgataggctatattgttgtgaatggttatactggagttgaagcacttaccgtgttttggattctggggtatcgaatggtagaggctgtggcagatgtatatagtggattattccaacagagagaacgaattgacatttccggaaaagagatgttaatgcggagcgggatttcaaccattacatttacaattatattatggttaacagacaacctgttatatgcggccatgacacttacattaacatcattggttattatgttgttttatgatttacatatgaaaagatactttgaaccaacgccggtgcatctggaatggaaagggattttaggtatttataatgcatgctggccattgtttgtgtcatcttttattatgaattatctgaacaatgcacccaaatatgcgattaacacatattatgatgagacggttcagaacagctataatattttatttatgcctgcatttgtgattaatttattaagcctttttgtattccggccacttcttacagatcttgccagagattgggagggggaaaatataaaagagtttacggacattgtgaaaaaaatgatgattttaattggtgcacttacgattgcagcatgtgtgggtgcttatcttttgggaataccaatattatctcttgtgtatggagttgatctgagggcatatcgaatggaattggtgatcattatgatatgtggaggactgaatgcctatgtatattgtctctattatgtggtaacagttacgggaaaacagatttttttattgctgggatatggagccggacttatatttgcagtatttctgggatcgggtttcgtaaagagccttggaatgctgggagcggcactgagttgtaccctttcgtttggagtagtatttatagtatttttaataataacatcctgtgtcgtaaaggacaggaagaagaaaactgaagtgtgataaaagatggaaaattttataaaaagaaagagggaatgaagagaatgagtaaaaagattttggtaacaggatgtaatggacagcttggtcgtgcgatcaataaggaatacgcaggaagtgatgtgacatttattaatacagatgtagtggaaggggaaggtgtgacagcacttgacattacaaaaattgagcaggtattatcacttgtacgtgcagaacagccagaagtgatcattaactgtgcggcccatacaaatgttgatgcatgtgagaagcagtgggatgcagcctatcgtatcaatgctttgggtccaagaaacttaagcattgcagcagaggcagttggcgcaaagatgattcatgtttcaacagattatgtttttgaaggaaatggtacaaaaccatatactgaatttgatgcaccgaatccggtgagtgcttatggtaaaacaaagctcgagggagagaagtttgttcaacagttttcaaaccatttctttatttttcgtacagcctggttatatggagatggaaaaaactttgtaaaaactatgctgaacctttcggagactcatgatgaagtgagtgttgtctgcgatcagcttggatcgccaacaagtgcagtagagcttgcaaaggcaatccatcattttgagggaacggaaaattatggtctgtatcatgctacctgcgagggagatacaaactgggcggactttacagaggaaattttcaaaagagcaggaaaaagcacaaaggtaaatcatgtaacaagtaagcagtataaacagatgaatccggcagcggctgaccgtccggcatattctattctggataattatatgatgagattagcggatggttatcagatggctgactggaaagacgcattggatgtttatatggcagagctgaaatagttaataaaatcctaagatgtgtaaaacttgtcttagtatataaaatatggtaaaatgacaaataattgtgatgataggaggatctcggaatgagaacttatttggtaactggaggagctggatttattggatcgaactacattcattatatgtttcgcaaatatgataatgaaatcagaattatcaatgtagatgcattgacatatgcaggtaatctggagaatttaaaagatattgaaaatagagataattacactttcattaaagcggacatcacggacaaggatgctatcatgaagatctttgaagaaaatgatattgaccgtgttgtgcatttcgcggcagaaagtcatgttgacagaagtattaaaaatccggaagtttttgtcaagacaaatgttctcggaacagcagttatgcttaattgtgcaaaaaaagcatgggagctgccggatggcagttttaaaactggtaaaaagttccttcatgtatcgacagatgaagtatatggttcacttcctgatgatggaaaaagctatttttatgagacaactccatatcagccacacagtccatattccgctagtaaagcgtcttctgatatgttagtgaaggcttatattgatacgtatcattttccggctaatgtgacgaatacatctaataattatggaccatatcagttcccggagaagttgattccattaattatcaacaatgctttgcacggaaagaaattaccggtgtacggagatggattgaatatccgtgactggttatatgtagatgatcatgcaaagggaattgacatggttcaggaacatggaaagcttggtgagtcttacaatattggcggacataatgaaaagcgtaatattgagattatcaatattatcattgagactctacaggaaattcttcctgatactgatccaagaaaagcaaatgtaagcaaagatttgatcacatatgtagaggatcgcaagggacacgatcgcagatatgcaatcgcacctgacaagataaaagctgagataggctgggaaccggagacgatgttcaaggatggaattaagaagaccatcgcctggtatttagaacatgaagactggatgaacaacgttaccagtggtgattatcagaaatattatgaagatatgtatcagggaaaataataatagcacaaatagcagtaccgtccgtaggtcggatgatactgcttgtttgcgttttaccaaaaagtgataaaatgaattttttcaggaggatgaaaaatgaaaggaattattttagccggaggatccggaacacgtttatacccattgacaaaagcaatttcaaagcagatcatgccggtttatgataaaccaatgatttactatcctttatcaactttaatgcttgctggaatcagagaagtactgattatttctacaccaagggatctgccggtgtttgaggagttattaggggatggatcacagcttggaatgagatttgagtatgcggtacaggaacagccaagaggacttgctgatgcatttattatcggcgaaaaatttattggaaaagatgcagtggcattggtattaggagacaatattttttacggacagagcttctcaaaagttcttcggagcgcagctgagcgtacagaaaatgaagccggcgcaaccatttttggctattatgtaagagacccgagagaatatggggttgtagaatttgatgagaatggaaaagcactgtccatcgaggaaaaaccggaaaatccgaagtcgaattatgcagtaccgggactctatttctatgacaatgatgtggttgaaatcgcaaagaatgtaaaaccatccgcaaggggtgagatagagatcacaagcgtaaataatgaatatctgaaccgtggaactttaaatgttgaaacattgggaagaggatttgcctggttagataccggaaatcatgacatgcttcttgcagcggcagatttcgtgtcagcattccagaaacgtcagggattatatatctcctgtatcgaggaaattgcttacaagcgggggttcattgacaaagagcagcttgtgaaacttgcacagccattattgaagacagattatggaaaatatctgatggaaattgcagagggattataaagtctttattttcatctatggataaaaaagattcgaaaaggaagtataaaaaatgggaaaaataaaagtaacagacaattgcaatggaattgcaggattaaaagtgattgagccgaccgtatttggggatgcccgtggatatttcatggagacttataattacaatgatttcaaagaggcaggaattgactgtgaatttgtacaggataatcagtctgcatccaaaaaaggcgtattaagaggattacattttcagattaattatccacaggacaagctggtgcgtgtggtaaacggagaggtgtttgacgttgcagtcgatctgcgcgagggttcagagacatttggcaaatggtttggtgtaactttatctgcagagaataagaaacagttctttattccaaagggatttgcccatggttttatcgtattgtccgattatgcagaattctgttataaggtaacagatttttatcatccaaatgatgagggcgggctgttgtggaaagacccggagatcggtgtggaatggccgatgccggaaggaatgactgaggcggatcttacattatctgataaggataaagtatggagtggaatctcagaatatgtcaaaaaccgtaaacaagttatagcttaagagaatgaaagttagaggaaaagcatgccaacggaaataaaacaagccaatatgctgaaagaaataataagtaatcgaaaattaatatgggacttgtcaaagaatgattttaaaaccagatttgcaggatcctatctgggaattatctgggcttttgtccagccgattgtaacagtattggtatattggtttgtatttgaaaagggaatgcatgcaagcggcattaatctcagatcgggaattacagcaccttttgttttgtggctgatagcaggacttgtaccatggtttttctttcaggaggtgctcagtgggggaacaaatgcgctgatggagtatagctatctggtaaaaaaggtagtattccagattgatatcttaccaattattaaattgatatcagctttgtttgtgcatttgttttttattgcatttacaattattttatatgcgtgttatgggtattatccggatttgtatacattgcaaatgttatattatacctttgcgatgatgatccttttattaggactgatatatgcaacatctgcaatagtagtatttttcaaagatcttggacagatcattaacattattttgcagataggcgtctggatgacaccaattatgtggaatattgatgggatggaattgaatccgattctgattacaattttaaagttaaatccaatgtattatattgtggcaggatatagggattctttgatcaataaggctggattttgggaacaaccaggcatgacaatttattattggattcttacaattgtattattcataatcgggacaaaaatattcaaaaaattaaagccacattttgcagatgtgttatagaaaggtaactgcatggataacatcgcaatttcagtagaacatgtaaaaaaaatatataaattatatgacagaaaccgggatcgcttgaaagatgcattaggattttcaaaaaaaccacttggaaaagagcattacgcattgaatgatgtatcttttcaggttggtcagggagagacagttggcattattggaacaaatggttcaggaaaatctacaattttaaagatcatcactggagttttgaatccaaccgatggggaagtcaaagtaaatgggcgtatttctgcgttgctggaacttggcgccggatttaatatggaatataccggaattgaaaatatttatctgaatggaaccatgatcggttttaccaaagaagagatagatgaaaagctgcaggatattttagattttgcggatattggtgattttgtaaatcagccggtcaaaacatattccagcggtatgtttgtacgtcttgcatttgcagttgcaatcaatattgagccggaaatccttattgtcgatgaagcactttcggttggagatgtattttttcagacgaaatgttatcacaaatttgaagaatttaagaaaatgggaaagaccattctttttgttagccatgatctggggagcattggaaaatactgtgacagagttgtccttttgaataaaggcgtaaagcttgcagagggtaaaccaaaggatatgattgatctgtacaaaaaggtaatggcagaatcaaagatggaagatattccgaaaaaagaaaacggtcatgcagcaatagaaggagttgcatggaaagaatccatgattttaaatccggataagcaggaatatggagataaaaaggcagagattattgactttggaattttcgatgcaacaggaaagattacgaatactgtttctaaatttgaagagtgtgttttgaaattaaaggtacagtttcatgaggatgtgttaaatccaatttttgcatttacaatccgggatttaaagggaacagatcttaccggaaccaattcacttattgaagggttagagcctgggctgatagaggcagggaccatacttacagtatcattcagacaaaaattgccatttcaaaaaggacagtatctgctacagttaggatgtacaggatataatggtgacgaattagaagttcatcacagattatatgatatatgttgtatacaggttttatctaaaaaagttactgttggatattttgatttgaactctatagtaagttgtaatgaagagtaggctatgggaaggcgaacagcgagtaaaatcagcgatgacaggaatcgctgtatataaaaaggagcattatgggaagaacacagaagcttgcagcaattataaaagagggagtaagaaatcctcagaaaataaaaaaaggattaaaagttttaaaaaatcagggaccggaaatctttaaacagcgtttatctgccagtgtaaattatgaacctgggtatggcagagtgaagaaagaaaaattaaaaaattatggtggagagattcttttttccattgtaatgcctgtatataatgtagaaattaagtggcttgataaggcgattgaatctatagaaaagcagaattacaaaaactgggagatttgcattgcagatgactgttctacaaagcaggaggtaagagagcacttatctgcaatgaaaaatagccggattaaaattaaattattagaaaaaaatcaggggatttcaggagcaaccaatgcggcagcagcgcttgcatccggagagtatatccttcttatggataatgatgatgagcttgcaccgtctgcattacatgaattttatcagaagataaaaaaagaaggttctgatatcatatacagcgatatggatattattgatgcgaaaggaaaaacgagagatccattatgtaaacctgactggtctccggatcttttcctgagccagatgtatttaggacatttgattggattcaagaagtccttatttgaaaaagtgggtggatttcgcggtgagttcaacggaagccaggattatgatctgttacttcgaatgacagagatgacggacaagattggacatgtccctgagatactttatcattggagagatcttccgagctccacagcagccaacccggagtcaaagccatatgcacagacagcaggacttaatgcgattcaggaacatttagaccgtgtttatggcaaaggagcagcgactgcaaatgagacagagaatttgtttgtctatgatgtgagatatcacatgaatgaggaaccgaaggtttccattattattccgattaaagatcatgcagatttgttaaaggctgcaattgacagtatttatgcgaagacaacttataaaaattttgaaattattattttaaataacaattctgagaaggaagagacttttagttatctgaagaaggtggaagaagaacatgacaatgtcatcgtgaaagatgcggcgtttgagtttaactggtcaaggcttaataattatggaatgaagttcgcaaccggagatgtctatgtatgtttgaataatgatgtagaagttattgaaccggaatggcttacaagactggtagagaaagctatacgaaaagatgttggtgttgtcggtggattgcttttatatgaagataatacgatccagcatgcaggagtagttattggaatgggtggctgggctgatcatgtattcaagggaatgaaaccgcagcactatggatcgccatttgtgtcaccgatggtaacaagaaatgtttcggcggtaacgggagcctgtcttgcagtttcgaaggcgacaattgagaaaatcggtggatttgatgagaaattcattgtatgtggaagcgatattgaacttgcacttcgtgcaaaccagcatggactcgtgaatatctacgatccaaatgttcgtctgtatcattatgaatctaagagcagggatgcaagtaaaatcccacagattgactttgatttgtcggatcagatgtataagacctaccggaaaaacggagatccatattataatagaaatcttgattattattgttgtcagcccaaaatttgtgccgcggtgcagcagactgtcaaagagcaggaggaaaaaatgcttctgaagagaaaaagagaaaccggacttccacaattggatacgaatgtatatgaaattacaccatacactttccgtaagatagaatatccgaaccgcagaatgaaccttctggttccgtctatcaatgcagagcatgtctttggtggaatctcaactgcactgaagtttttcgatactttagtgaaagcattaggctatgatgcacgtattattttagtagacgcagagccagacaaagcagccattaaaaaatattccgatgagtatacatttgtaaaagcagaagatgattctctcgttgcaaaacagattattccatacagcaatcgttttaaccgcagtattccagtgtcagagaatgactatttcttatttactggctggtggacagcgtattgttgtcaggatgcttatgttggatttgaaaatacatttggaatcaaaccaaatatttttctctattttattcaggattatgagccaggattttactcctggtctacgaagtacctgcttgcagattctacctacaaaagtgattatccaacaattgcaatttttaacagtatgttgttgaaagaattcttcaatgaaaatcattaccattttacgcatagctttgcatttgatcctgtcttaaatgatggattaagaaaagcgttagagcaaatgcctgcacaggttgataagaaaaaacagattcttgtttatggacgtccaggtacggagcgtaatgcatttaaccttgtagtagcggctctgaaaaaatgggtgatgatgcagccggatattgaggaatgggagattctttcggcaggggagatgcaccgttcaattccgcttggaaacggcaaagagcttgtctccgttggaaagcttacaattgaagaatatgcgcggactttgcaggaaacttacgcaggaatttcactgatgtgttcaccacatccaagttatccgccacttgagatgtcggtatttgatgtaaagacgatcacgaatacttatgcgaataaagatcttaaggatttcaatgataacatggtatcactggataatatcagtccaatgaacattgcaacacatctgactgaaatctgtaaagcttacagaccgcaggtagaacatgtgacagcgaatccattatatgtaaaaaatgagcatgtatttgattttataaaggatatcaaggagattcttgggtaaaaaataatagttgtagataactatagaaaagaggttctatgacagagcagattggaaaagtaacgttagattatacattttataatggacaggatcaatatagtgacggggacatcgagaatgatctgttacagcttattatggaagaaccagacgtagagaagatacttgcagaagatgaccggtggccagtgttatatcatttttcacctgtcagacaaaatatattggagtggtatccttttaaaaaagatgcatctgtacttgaaattggggcaggatgtggagctgtcagtggagtactttgcagaaatgcaaagcatgtgacaagtgtagatctttctaaacgcagatcattgattaatgcaaatcgtaataaagaatacgataatcttacaattatggttggaaatttcaatgatgttgttttgaaagaaaagtatgattatattacattgatcggagtattggaatatgccggttattacacggatgatgaacatccatttgaagcctttttaaaaaaaatcagtggatatttgaaagaagatggaaaactgctgattgctattgaaaataaatttggattgaaatattgggcaggctccagagaagaccatactggaaaattttttgatggtttggaaggttatattgatacagatagtaaagtgagaacttttagtaaagaggcgttaaagaaaataattacagatgctggatatgggaaagcagaattttattatccgtttccggattataaattccctgtacagattttttctgatgagtaccttccacgagaagatgatcttaatataggtttagatactttcgataatacaagaatgatgctttttaacgaaaacagagtctatgcaaatcttttaaaagaaaaaaaatttgaattttttgcaaattcgttctttatagaagttacaaaatagtgtgaggtgatatcttgaagaaaatttactcaaaaattacaaaagagagaagaaaacagtttcagatagaaacctacataatgaaggatggggaacagagactggttgtaaaaagagcattggcaaaagacggagcagcacatatcaggaagatgtctgattattatgaaaaaaataaggatgaaggtatcctgtgtccatccaaactgatttcagaaaacgagatcgcttttgaatttttaaccggggagagtctttgcaatacaatgttggaggctcttgaggataaagacgaagtaagatttctttctttgcttcgaatgtatgatggaatcataagaagcaatgttaatatagaaagaagaacatttatgccggatgcacaatttgtacaggtgtttggcgaagtttctttcccagatgagatggaatgtggaaaagaaatgaatatcgatatgagctttgataatatcataaaagatcagactgacagcaaatataaaattattgattatgaatgggtattttcatttccaattccagtgaaatttgtaatatatcgtgcggtgtctgctttttataccagaaatggcagtgctatgaaagatatcatgacaatcaatgaaatttatgattgctttgatattacggaagaagaaattgttatatttgaaaatatgaatgaagcatttaatcaatatgtatatggtgggaaaaatggctataacgcaagccttattgcttacaaaaaagaagtatacgatgtgaaaaaactgcttccggaggaaaacttattcttacaggtgttcttaaatgatggaacaaactatcttgaagacaaggcaattacaaatcatattataggacagaatgtaaaattgaatattccgattgaattcacacaggatgtatcagaaatacgattggatccattaaatgtttcatgtgttttgcaaaatctcaaggtgcaaattgtgacaaaagataacaatgaatatgaaattgaacattatcggcacaatgccatcataacaaaagatcatgattttatatttgcatcggaagatccgcagatcatatttgaaaatcaatgggaaaataatgtcagagagatcaaaattgcatttagaatcagggaagcagggttgcaggacaatccgatactcagtgcacttagtgagttaaaatgtcatatgaacaaagtagaaaacgaactggagtatattaaggggacgaaagtatataaaactttattagaacgcaaagtcgataaagtgttaggagaaaatgaatgaaaaatgcagcaggaatattgctggtaatttatttgttttttttagtaccattgttagcaggtgcatttattgatgcagcagcaggtgtaaaaaggagaaatatatcaagcacatatgcaaatggatttgttgctatgcttggaatattttggggtgttgcggtactttttttatatcgtggctgtacattagaaaaacttagtatggtttggatgcttgcgacgattacgatatgtgtggtatccattttagcaaataaaaaagcaatatatggatgttttaaacataaaagaaaatcagaaaatggacacaagaccgtaaaaattgccatggtagtatccataatagcaatattgttttctgtagtttgcgtaaaaccacagatggagcagacagtacaaacagtaatgacatcaattgataccaattctgcatatatatatcagccatatactggcgaacagtatcctgccacgcagatggaaaagatattttcgccttatgagatgctatatgcggtcactgcatgggtttccggattacatccggcattgctgataaaggtaatacttccattattcattttaccattttttatgtgctgttattgggaaattggaaagttcttttttaagcaggaaaaaatgcaggcagtatttttaataattgtagaaattatctattatgtaccaatatatacagcggtagaaactccggtgacaggcatattccgaagctgttggaatggtagtgtaatgttggaatgctgcattcttccatatgcgtttttacaagtgatgcgtatgttaaatttcatgtatggaggagaaaaaaataaagtatccgattgtgtaaaacatccggttatgatgcaggcagtattatttattattttatatccggcggcacaattgttacatcacaaaggctggttttatgtgttcctgatgatgttgctgatgattcttgtctggtttgtaaggaaggggtataaatatgtccgggttgtgggaagacattaaaaatgcatatttttcttacaatgggatggggacaaatgtttttttcctttttgtgtcaatattttatttattgatcacaaataaaaaaagacaaagaaatttgttaatatatgagatttttggtatactttttctgatgacgccggggattgcaaatggcatactaaatatgagcggtcagaagacagatcattggatggtctatggaatactaaacatagtatcggttgttggagttgcaatgacagactatctgataaacatacccactaagaaagaaaaaataattgtcatagtgatatatattttactgattcaggcagggatgggattaaattatacgtcgcagcatttggaatttatcacaaacagttataaaatatcaaatgaagtcatggagatcgctgaacagttggaatttgtagaaaaaccaagagttcttgcaccggaagaggtggcaggtgagcttcgggaatatgataccaggtttgctgttatttatggtgaaggtttatcttttactcaggagaatctggaacagctgcagatagaaacagaatcctatggctgcaattgtctggttattaattctgagtatgacaatattgaattttttaatagcattggatttagtaaaatttataatacagaacattatgaagtatatgcaaaataatttatagagaaaagtggcggacttatgaaaaacttagataaaacattatggatcaaaagaatatttatggtgctgatggatatttgcattgtaatattgacaagcatcacggcattgattgtaagattcgaatttagtctttcggctgtaccaaagtattatattggcgttgtatggagttcattgccggcaacgttagtgatcgcgattattgtattttatgtatttcgtttgtatagcagcctttgggtatatgcaggggtaaccgaattattgtatcttgcagcagcatgtattgtagatacgctactcaatacagtgacgattcttctgaattacagagatcaggagtatccgctgcctagaagctggtattttatttatggaacactattattggcatttatgtttatcagccgctattcctaccgtgcagtcagaactttttttggaaaaaaagtggatgagaagaatcttaagagagtgcttgtagtaggcgccggagaagcaggaaattctattatcaaagaaatttccggcagtcgttttgtgaatatgcatattgtaggttttgtggatgatgataaaagcaaaattggaaaatatatgcatggtgtcaaagtccttggagatagaaatgatatcatagaaattgcaaaagagtatcttgtagatgagattattattgcaattccgacagcgagtgcaaaagagacaaaggcaattttagatatttgtaaacagactggctgtgaattaaaacgtttacctggtatgtatcagttggtaaatggggatgttagtatcagtaaattaaaagatgttgatgtaaatgatcttttgggacgtgatccgatcacggttgatcttgattccattatgggatatgtttctgataaggtagttatggttacaggtggaggtggttcgatcggcagcgagttatgccgccagattgcatcacacaatccaaaacagttagtgatcgttgatatttatgaaaatactacatacgatattcagcaggagctaaggagaaattacccggaactcgatctggtcgtattgatcgcttccgtaagaaatacaaagcgcatggatctgatttttgataaatatcgtccggagatcgtatatcatgcggcagcgcataaacatgtaccgttgatggaagacagcccgaatgaagcagtaaaaaataatgttttaggaacatggaaagtggttcaggccgcagataaatacaatgtaaaacgttttgtcatgatctctacagataaggcagtaaacccaacgaatattatgggcgctaccaagagaatctgtgagatgattattcagacatacaataatcgttctaagacagaatatgtagcggttcgatttggtaatgtacttggaagcaacggaagtgtgattcctttatttaagaagcagattgaagcagggggaccggttactgttacgcacccggatattatccgttattttatgacaataccggaagcagtatctcttgtgttacaggcaggagcctatgcaaaagggggagaaatctttgttctggatatgggagaaccggtcaagattgtagatcttgcaagaaacctgatacttctttcaggacataaacccgacgaggatatccagatcgtatttacaggattaagaccaggcgaaaaactgtatgaagagatgctcatgaaagaagaaggcatgcaggaaacagccaacaaattaattcatattggtaaaccgattcagatggatgaagagaagtttttaaaacagttagaagagatcaaagagcatgtggtagaagaaccggatgatatacgggaatgggtgcagcgtatggttccgacatactctattcagaatcggtagaaccagaaaacagggtatataatatggaaaaaatttgggaagtcatcttaattcttgtacttgcaggaatgggatttattttgcaacttgataggaaaaaggaaaatggaacagataaaacaaattctaaaaaataaaaaaatatatcttagagattttattgcaattattgtaatatttttcctatctttatttgtagaacaggtattattacagtggaattcgtttaaaaacgaaaaatatgagcagacttttcaggtgagcgaagtacaaaaggcagagaataaagatggagagacaacgtatgattttttatttgatggaagatatgtgagctctatctatttgatttatcaaagcaaaacggacatcagttccagaatggaagtgacattctatgatggatatggacaaaaagaagtgatggaactggaagatactgcatcatttttgcttggaaaatctgcagtttgggtagatcagaaagttgacagcctgaaattgacagtggaaaacaaagatgcggataagttaaattcaataatatttgtaaatcacacggtattttcctgggcaaagtttctgcttgtattttcagtattgttgctaagttacttatttgtttctcattgtactttttttggaaaaagacccgaatggatgtacgcaatggtatcagttgcattaggaacggtgattatcttatcagcacatcattcatttgattcatgggatgaacagattcattataatatagcatatacagactcctgggtatggaattatatggagtacagtgatgctgtgatgtcgaatgtagaaatgcgtgtaccaacaggggacacgttagaggaagaacaatggataggagaatggcttaatcaggcaaatgataccgttgtattatcatcacaaaaaggtagatttctcagatatggacaaagggcttatcttccacagatattaggacttggattaggaagaacactgggattgtcttatgtagcaacagtatttttaggaaagttttttaatttactgttttgtacagctgtcgttacgtgtgcgattcgtttcagcaagtatggaaaacgtacattgatgtgtgttgggttgctgccgacaacggtatttcttttttcgtcatttacatatgatgcatttgtgatagcacttttaatgttgggcatagcattgtttgtaacagagtacctgagtgaagaaaaaattcaaacaaaacggacgatggtatctattcttgctatggttgtgggatgcttttcaaaggcggtctatattccatttttggcattatattggcttatgccgaaggacaagttttatagcaggagacaaaagaatctgtttaaagcaggaatctttgtcttattaatattaatgtttgcgtcctttatactgccgttaataggtaatgttacaagcggagcagaggtaggagattaccgtggaggagatacgagccagacaagtcagttatctatgcttttgggatatccgttgacgtatacaggagttttgttgaaatcacttggaacaacgtttgcatcttattttattggttccaaagtgcttgcaaattttgcataccgtggaatctatgatggaataggatattttgtagtactgcttacgatgttgtttacatttgtgaccgattttggaatgacagaaaaaatatatgatgcacagataaaaagaaaaatattcatgatgaaaatatggaatgcagtattaatatttggaacagcatgtctggtctggacggcattatacctggattttacaccggtagggtcgatggtaattaacggagtatcaccaagatattatttgccgctgatctttccactgagtctcatttttataaaccaaaaagtgagatgcagcatgaaattagagaattatcagagtcttatagcgtttttaatgctgataggcacaggtatatctatttattgtctgatgcttgcataaattgcagatacatgaaaggaatcaaaaagatgaaacagtttacaatttcacagaaaatttatatgggagtgaaaagggtaattgacattttattatctgctctggcattaattctgttatcctggttgtttttgattttatgcattgcgattaaaattgatagtagaggaccaatcctttttaaacagaaaagggttggaatccataagacacactttatgatctacaaattcagaactatgagaattgatacgccaaaggatatgccaactcatatgctggctgatccggaacagtatattacaagagtagggaaatttttaagaaaaagcagtctggatgaattgccgcagatcatcaatatccttatgggaaagatgagtattgttggaccaaggccagctttgtggaatcagtatgatttgatcgaggaacgggataagtatggtgcgaatgatgtaatgccgggactgaccggatgggcgcagatcaacggacgtgatgagttggagatagatgtaaaggcaaaactggatggtgagtatgtgaaaaaatttggattcataatggatctgaagtgcttttttggaacgatcacagcagttttgtcacacaaaggtgttgtggaaggtggaaccggagaaatgcataaatagctagtagctgcggataaaaagacatgctgggttatttgagggaaaataatgggaaaacagattttgataaccggaaccaacagttatgttggcacttcattcaaacagtatatagagaaaaaaaatggaaacatgccgttggaagaccgatggcatgttacatttgtttctgtgagaaattcagaatggaagaaaatggatttttcgaaatatgatacgattctccatgtggctgcaattgtacatcagaaagaacagccggaaatggaggcactctattatgcagttaatacaaaattgacagaagaacttgcggataaggcaaaggctgagcgggttcgtcagttcgtttttttaagtacgatgagtgtttatggaatgacaatgggacagattacagaagaaacagaatgtacaccgattactttttatggaaaaagcaagcttgccgcagaacggtacttatgtgagcaaagaagtgatacattcaaagtagcagttatcagacctccgatgatttatgggaaagcttgtactggaaattatgcttcattggagaagctggcgggcaagatacctgtttttccgagagtgagcaatgagagaagcatgatatacatcgagaatttgtgcgagttcttatatcggattataagaggagatgcagatggcaactattgcccacaaaacagccaatatgtgaatacatcagatatggtagcacggatcgccgaaagctatggaagaagtatatggctcgttccgggattcgaatggatcatcggtaagcttgccggaagagttaacatattctcaaaggtttttggcagcctgacctatgaccggaaactatcatttccggaagaggtgggagagtatgaagtggtggattttctggagagtataaaaaaatctaaggagtcattatgaaaagaataggtgctgtgattgtaacactaatattttttattgtgctggcgtataatgcgtactatgctccattgccggatattaaggtaagtaatacagagacggttatcattccgggagtggaaaaagaatacacttttttgtttttaacagatatgcatatggctattaaaacgaaacaagatctgggtgcttctctgggtgatgcagatgaaagaatgaaggcgtttgtcaatgaggatggaatactttcgtctacacagtttacagaatggattgcatatgccaaccgcttgaagccggaaggtgtattaatgtgtggcgatatgatagattattattcgcaggaaaatgttgaatttttagctgacaatcttcagaaattaaacgttccttatttgtacgtgttgggaaatcatgagatgtattcaccgtggaatgaaacgattgcagaagatgcggagatatatcatttgttcagagagaataacacagcatttcaagcatgggaatttccggagtttacaatatgtgcagtagataatcaatcatatcaggtagcacctgaggcactggatgaaatgcaaaaggagatagaaaagggtaagccaattattttgctggcacatgttccattttacacatcacagatagaaactttaaaggaagcttctattaatacatggggagtgccactgattatcggtgagggagcaagagatactacagaggttacaagaaaattcatgaaaatggcattttcagatgaaagccctgtagtggcagtttttacaggagataatcatttttattataagggaatgcttactgataaaatagaagaatgcgtgatagatccaagctttgcaggaaacggcactattattaaaattaaagcgaaggagtaatagttttaaaatatgagtaaaatatccgtattgatgtctgtttataaaaaagaaaatccagaatatttaagagcgtcattagaaagtatattagttcagacgaggaccgcagatgaaattcttctgatcgaagatggacctctgacacaggaattatatcaggtagtggcggagtatcagaaaaaatgtgattatctccatgtgcatgctatggaacagaatgttcagcttggccgtgcactggcaaaaggagtggaattatgcaaatatgatctgatcgcaagaatggatacagatgatattgcgatgccggatcgattagagaaagagggggcatatatggaagcacatcctgaagtggatgtggtaggtggtgctatccgggaatttaatgatgaaggaaccatagaccgcgtcaagaatatgccaaagactcaggaagagattttagagtatgtgaaagtgcgtaatccattaaatcacatgacagttatgtataggaaagattctattttaaaagcaggaaattataaacattttccatttctggaggactattctctatggagcaggatgttgtcacagggatatcagttccggaacatggaagatatacttgtccgggcgagaacaagcatgggattagtaaagcgaagaagtggatgggcttattacaaggattttcaaaaacttagaaaacagcagcacgagctgggaattacaaatacgtttgaatatataaaggtgcaggttggaacttttgttgtactcatgatgccggggtggatgaaggagtactcttataagagatttttgcgcaaatctgaataactaagaaaaaattcatagaaaaattcttttgtgtaaagaaaattatgctataaatgcttaaagggtaaggcataaatggaggaaaaaatcatgcgtgaagcccgtgtgctggagatcattggaaaacgcccggtgggcggtgtcgggacagtgatgctcaattatcagagacatatgaatatggaacgtgtccagatggattatctgatcttcggagagcaggaagagacatttgataaagaagtgaaaaaacttggctcaagagtttatacttatccggcattgtccggcagacagatgagacagacaaagaaatattttgaacagtttttttcagaacatcacagtgaatatgatattgttcatctccatgcaccctacattgcatttttatgcctgccggttgctgcaaagtatggaatcagtcatcgaattgtacatagccatgcaactgtatatgcggagagtaaaggaaaagcggtgcggaatagaatgctttggagcatatctcaaaagtacattaccgatcggatcggatgctcgcaggcagcaggagcgttcctttttggcaaaaaagattatactgtgttaaaaaatgcgatctgctgtgatgaatatgcctataacgaaacagcaagaaatgaaatcagaacacagtatcaggcaaaagataagcttgttattggaaatgtaggccggttcagtcagcagaaaaaccagatgtatctggtagatattttttcggagatacgaaaaatccacaaagacagtgtattatggctggtgggagatggcgaacttcgaccacagattgtggagaaaataaaacaacttgggttgataaattcagtaaaaatatttggaatggtggataacacaggagagttatatcaggcaatggatgtcatggtcatgccatctttattcgaagggctgccaatgactggtgtagaagcacaggcatgcggtctgccatgtgtgttttctgatacgatcaccagagaagtggatgtgatgggcagtccattcctgtcgctggaggaaagtaaggcagaatgggcgaagacagcggtaagagcggcaggacgctataaagacaacggaaaggcaagacgaagttttggaaaagagcttgcagaacatggatttgatatccgtgtggaggcggaacgattagaagaaatgtatgttggaatgatgtgagacatacagaatataaaaggcataaatatgaggaaataatatatgacaaagaaaatgtttcagatttccagaatattgatggttgtgcttacgattggtgtgtgcctgactttattgttagatggacgtgtcatgatattggataagcatatctatcttagatgtatgttggaatttgccagcttgacattatttttaataatttccagattatatgaagcaaaaagaaagatatttagcacaggatatttattcctgatgatcaatgcttttataaacggaaccatatgtccctgctattacacggacagccgtttgctcagagatgagcgggataattattatatgcccaatgatcatttcatgatttatatgaaggtgtattttatattaatgtctattattctggtttatttgttgtgtttaaagcatacaactaatgagataaaaaggtatgattttatagaatataaggacacggatgattttgctatacttgcaggcagtgttctgttggcacttccggtcatggaaatgacagggacaagtggcgttatgttaatgacaccggttttgtgttatttctttggcagactgatgtattcgaaattcagtttatctcagagtatattttgctttattggattgttgcttggaatatatggaatttatcggattttagatcagagatatctggtaattcagtatgcaatgccagtaatattagtgttcttagtgtttgtagcagtgaatgatgatagaagaaaaggaaagaaagttgttcctttaatgatacttggaattattgcagtgctgctttatggtatgctgtctgaaattgtaaagttaaatcgttattggaatggaaattataatctattatatgaattgacaaatttccagagttacattgattttggtgctaatcagttttatcgaatttttggtatctggacagaactaggcggtaatattatagattttgtccataaaaatggattcttctatggtattacctatgtgaaatttctggcaccgtattttggatttgaatatgttagtctgcctgccatatcagcaaggtacattcaggcatcttatgcacagcccggcttgattgcagaaggatatgcaaattttggaattattggatcggttgtaaatatgttgattccatttctgctggcagagtactttttaaatttatttttaaaaaaacgggatggattgtcaatttgtctgatgacaattccgtttgtgaagatacttttggatggaggaactattaattccattattgtggggattggaatttgtattttaccatttagtatttatttactgttgaaaatttttaatataaatgtaaagactgttgaaaatatcagaatcagagtatttaggaagaaaaagagacaactgcaaggacggaagagcaatggagaaaataacagtaatcgttccagtatataatgtagcatcttttctggaacgggcattaaaaagcataacatgtcagacatacacgaatctgcagattctgttaattgatgacggctcaacggatgaaagcggaaaaatctgtgatgactgggtgaaaaaagatagcagaatacagtgtgtccatcaggagaatgcaggtgtatctgttgcgagaaatcatggactggatcttgcagttggggagtacatcatgtttatagatgccgatgactgggtagaacctgaaatgatagaaagtttgcatgaactgattcttaagcatcaggcaggtgtaagtgcctgcagatatgtggagtctcatcagacagaatttctgagcagggatgaaaaaaaagatggacaggttaccattgcggaaggtcaggtggaagcaggaattcagctattgttaccatggtctgtatattgtaaattatatagagcagatttattacataatattcgattaaagaaatacaaaatagcggaagacctgttgtttaatacagacattatctgtgaaggtaagctcgataaagtagtgtttatcgatattccgtattaccattattttatcagggatgacagtgcaatccgtcaggaataccagaaaaagtatatagatggtgtgaaggtagaagaaaactgctatgacagactgattcagatctcgccacgttttggtgatattaatattgtcggttgttcggtcagtatgctgttcgagcgtatagcagagttgtcatatgcggaacgaaaaaagatacaggaagatttcagatggtgcaagaaaaatgccaaagaatataaaaaggcattattgaatgtatcagatagacacagaaaaatatctggagtgctgaaagtatatgtaccagatttatatctatggacattgattatacggaaaaggaagaataaatgagcagagaagacgaattaatatcagttgttgtaccggtatatcatgtggaaacatatatagaacgctgcgtggaatccttattgcagcagacatattccaatctggaaattattctcgtagatgatggcggagatgacagatgtccccagatatgtgatgagtatgcgaaaaaagatgcaagaataaaagtgattcacaagaaaaacggaggtctttctgatgccagaaatgcaggtatgagagcagcttcgggaaaatatcttgcgtatattgacagtgatgattatattcagccggatacttacgagaaaatgatatatgctctgaaaaaagagaatgctgatattgcagtatgcaattatgaagctgtgacagaccaggggcagagtattaccgagaagaaccagaaaatggatattaaggacagaacctattcatcacaagaggcaatcagtaatctctgcggaccgaattatcattattgggtgactgcctggaatcgattatataagataaagattgcaagagagatcagctttccggtcggaaaaatacatgaagacgaatttactgcacatttattttatgataaagcagaaaaaattgtgggaatctcggagccgttgtataaatatgtgattcgcgagaacagtattatgacaaagaaatacagcgtgaagaatctggcatatgtggaagcagtgaataacagaatagaatattgcatggaacatggactggaagaagttgggcaggcgttcttacggtggatgtcgcgttatcttatgaatgtatatgataaacttgatataaaagataaagaggtcagacagacctatgataaatatgtggagatgtatctgaaattatatcattccattaaggagaaacataaattggatacgaaaacaaaagcagcaacatttatgctggttcatactccaaaactggcaagttatatatcaaggaaaattttgaagtaaaaggaaaacggagaagcatatgaaaaaaatatgtcttgttgtaggaaatacattgcctgtaccggcagtgatggggggagctgttgaagaacttatcacaatgctgcttgatcagaatgaaatagagcagaaagcagaatttattattttctcaagagagaataaaaaggcagaaagggaagcaaaaaagtataagtattccagaattatttatattccagacgatactgttctggataaggtaaataacagaatcagaagatatgcttccagtgtgctgaaaccaggaaccttgttggattccggatattatcgcaaaatttaccatattctgaggaatatcaaatgtgatgcaatcgtctgtgagggtggtctttatcatgaatttcgtcagttcgcaaagaaatttggaaaagagaaaacttatctgcacattcatcatcatgtaatggcagatcctgaatatgatgaaatctttggaaatattattgcggtcagtgaatttgcaaaaaaagaatggctgcgtactacaaaacagaaaaaaacgggtgcgcatgttgtttataactgtgtgaatgaggcaaaatttaataaaaaaataacagttgagcagcgaaataagcttagagcacagttaggtctgaaggaagatgactttgtagttttatattgtggaagaatacaggaagtaaagggagtccgggaattattacgggcatttgcagggataaaagagcataattgcaggctattgatcattggaaatgctgatttcgcagtaaatacgacgacaccttttttaaaggaagtagaagaattggtgcaacaagatactgacagaatcagatttactggatatattgagaacgcagaattatatcagtattatcaatgtgcagatatgcaggtcgttccatctatgtgggaagaggctgccggactggtagcgattgagggaatgttatcaggacttccattagtcgtaacaaaatctggcggattagtggagtatgcaccaaaagaagttgccatgcagatagaaagaaacggaattgtagagaatctcaaaatggcaattgaaacggttatggacaatccggttgaacgaagaaaaatgagtgaagcatctgagaagcgagcaaaagattttaccagaagcagattttataacagctatctgaaagtattcgaatagaatacaggagaggaatggataactatggaagttggtatattaacatttcataatgcgcacaattatggagcgtctttacaggcatatgcattaaaaatgtgcatacaacagatggggcatgatgtgacaattgtcaattatcggaatcccaaaatagaagaacagtatccaaagcaattaagaccgaaatttacaaaaaagattttgaatccgaaaaactggaagcagtttgtttatgatacaattcgaggaatttatggacaaaaagcatggagcagacaatggacggcatttgatcaatttatcacagaagaattactagacaatgataggcggttaataggagtagatggggttgagtgtttgcataaagatgcttatattctgggaagcgatcagatttggtcaagttttttgacgggaaaattggatcctgtctattttggtgagtttaagaaaaaggaaagaattatttcctatgcggcaagccttgcaaatggtaaaatagcagagagtgaggaagctgcgtttgtgaaactgttgaagaatgtagacgcaatttctgttcgggaagaaaaactggcagagcagttacgacaattgacaggaagagaagtgtcaacggttgtagatccgacattattacttaaggcagctgattatgagaaaattatgacaacggagaggaaacttccagatggtaaacttccaacagaggaaaaatatgtattcgcatattttgtagttgaggaaaaggctgtggaagaatgtgcgaagaaagttgcaagaaagctgggattgcagttgatagaactgcattattatcatatgccagagaatagtgaagtgaatcagtttgcagattttggaccagcagattttctggcctatataaagaatgcggaaatggtcatcactaattcatttcacggaactgtattttcagttatatatagaagaccattctacagtgtatataagaaaaatggcagggtagataatttactgaaatttcttcagatatcagaaaaacacgtatccagcgcggaagaaatcgacgagataacagagattgattacgaggatgtgcataagagactggcagagtacagagaatcatccttacagttcttacgagaaaatttgaaatgaggacaagacaatggttttcaattttgagcaaaaaccaggacagacgttagaaaaaaaatgtatacaggaacagattacgccaagagtatctattgttacgccgtattataattcgggtcggaattttgaagaaacctatcgatgcattataaatcagacaatgcgggaatttgagtggattattatggatgatggaagctccagaaaagaggatattgaattgttagagcgtctgggagaatcagataccagaatccatgtgtttcaccagaaaaacggaggtcagtctaaggcaaaaaatgaggctgtgaagaagacgatgacagacattattgtgtttttagacgcagatgatctcgtggaaccattttatatagaatatctttacaaggctttgcaggaagaacccaatgccggatggagctatatggatctggtaggctttggaagtgagcaatatgtgtggtgcaagaagttttcggcaggcagaatgacatttaataatattcttgtcaatgcagcagcatttcgtaaggaacagtttcttgcagttggtggcttttctgagattgcaaagcactatgatgaggactgggcgttatatctgaaattgatgagtaaaggtgtatatccggtacatattccaatgattggtttctggtaccgcagaagtgcaactggtatgcagaaaaccgtaagaaataatatttctatgagagaaaaatcggaccggtatattgcagaacttgcaaagcatgtagatatcagtcttagcgagaaaatctataaaggaactcttccagattgtgccatcaagagcgaatatagcagaagtgacagtgtgatcgcaaaaatgtgtacaaacagaggaggactcaagctggtaaaatgggtatatggaaaaagaggttaaattgacttctatatagatataaactatactgaaaagatagcaatgcagagaaaggtaattgtttatgagtgacaataggaaagaaaataaaaaagaaatagatctggaattaaaagatattctgcttgaatttttgcgtagatggaaaataatcgttttattttcgattatttttggactcgtattcggtgcaatgagatatcggaaagactatgcagcagcacatacaccagtaccggaagtaaagaatacaactctggaagatgcatatgcagatctggacaaagatcaatatgagcgtgtaatccttgctgtttcgttgaaggctgcaatagattccaaaagtctttatatgaatgaatcagtgttgatgaacattaatgcacatgcagaggatgccgtgattttgcagtactcagtagaaggcgctgaagcggagaatattgtaaatagttatgttaattatattaacagtggaagtattgtttctgatattaataaagaggaaattcatgtagcagagggttatctgtcagaattgatagaagttcttccaaatcagacagaggatgcaatgaaaaactttacagtgaaagtaatgaattctgatgctgaaagcgttgggttattggcggatgccgtgaatgatcaattaacgacatatgctgcaaacttaaatgagaataatcaaacgcatattctcaatctggatagtagaaaacaggttcagattatagatgaggcactggcagaaaaacaggatgcatatgcacaggagacagaagatcagcagaataaacttgcatcaattaaggccgatatgaatgcaaatcagcttcgtgtatatctggatatggagaaagacatctttatctggggagatgacgaagaggaacagacagaaacagcagaagatagcgtttcaggtacagaggttgtaaaagtatcaattaataagaaacaaattatgatcggtgcagtggcaggcgcagcaattgcagttgtgtatattttcctggcataccttcttagtacacgtatacgtacgaaggatgaagtcgagagcatttatcagacaaggctattaggaacagtcagaaaagaggaaaaagatcacccaatcgagaagtttgtatggaaattagagaactttggacataagaagcttttatatgaacagcaggttcagatgctgatttccaatatctatatagcatgcagggatagaaagacagatagtatatatctgtcaggcagtattttagaaactgtagacaaagatttattaacgatgttggaagcggggttgaaacagaaaaatattcacgttgtctttggagatgcgataaactacaatgcagaagaactccttcgtgcagcagaggtgggatccgttatcttcattgagagaagaagaaaatcatactattctgaaattttaagtgagatgcagctttgtgatgcaaataatattcagattcttggaatgatcatcttagaaaattagggagttgcaggagaatggatacatcctatttatactcgtataatgcagagcgttatcaaaaactggcagagcgaaagttgccatgcagggagaaattgaatacaacagaggtggaacaggggtatcttttgccaaatcgatttgcaaaaaaccgtctgtttggttgtggaggagtgcttgatgcggaaaaaaattatgtgaaagcatctgaaatgaatgcgtatgcaaaatatgcagttccggtcacagcgcaagatgaaaaagaaatttatctgggagaaggatacaccattgatgatagtaaagttgaatatctggacgaagaaataatatatctgggttatattaataatcattggggacattttctgatcgattgttctaccagattgtattattatcttgaacatatggatgaaaatcataagtatgcatttcttgtgaatgagaatgaatattatcaggcaatagctccgatcaggcgcttttttgaattattgggaatagcggagtgtctgattttcattcataaagttaccagatgtaagaaagtgattatcccagagcaggggtatatgattaatgcatattattcaaaacagtttctgcatgtattcgaaaaggtggcagagagcgttgattgcagcaggtatccatcttatgagaaagtttattattccagaaagcagtttaaaaaggcaaaagggacggaaataggggagaatattttattagacctcttttctaagaatggatttacgattatctctccggaacagttgacactggatgagcagattgcagtcgtgcgcaatacaaaacttttgtgtggaattattggaacacttggtcataatatgcttttcgcaaagccggaacaacatatgattctggtgaataagacacacaatataaatgttgcacagatggatattaataagatgaagaatcttgatatgacatatattgattcatatctggcagaatttccatctctgataggaaatggaccttttctgattacatacagtgaaatgctaaatcagtatgtagagaagcataattggaagaaaccggcagaagatgtgatcagtgaaacagtattaaaaagaaatttacaagaatatgaggaaatgtaccgaagcagaaaccttaagaatctgcggttggtatatgaaaagaacccggacagatttgattattttgcaccggatcatcttttggaacttgagatgcggttttatcatctggaacatcctgcgacgatgagagaaaaaatcttttatcagtataatcgggtaaagagagcgtttcgtagaatcgtgaaacgataatggagcatatacggaatgattatgatcataaaggcgataggagtcctgtttatagatatagccatatattatgtaataggtactgctatcacagagagatttaaaaacagaataaaaaggaatgtagcatttcacataattatagggtttattgtataccagattatttttcaggtttgtgcgattcccttcatttggttgaagcggagtctgacagaattaacatttgtatggactgcattgataacagtcatcgtaattgtggcggtggtgaaagcaaggaaacggattccagaagatttttgttttgtgaaaaaaatattaaaagaacacagactgcttatgggtataactataatagcagtccttattgtatgctggtatacaacactgaatggggaattgaatgatgattctctgtattatattggtgttgtaaatacaactgtaacaacagatacgatgtttcagtataacgcttatacaggtgttgcaatgccatctcattatttcaggcgtgtactggtaacatttgaaattaatgcagcagttgtgtgcaggatatttggagtacatccaatcattatcatgaggatattcagaggaaatctgaatgtcatattgacagcactcacgattgcattgataggaacaactgttttctgtgatgaaaaaacggtagaaaagtcggcaatacttgtctgtgtttcaatggctctttactttatagcagatagtacaatgtatagtaatgcaacattttttttgaccagaacatatgaaggaaaagcttatgcaggaaatgcgctcatttatttcatggtttatctgtgcatctgcctgatgcagacgaagagaaagtcatatttactgttgataggattattaatatggggatgttctgcaatatcatccacagcagctatggtcagtatagcaggtgcaggtacgatgcttttagcttatctgatatccagaacttttaatacgaaagccagaaagatgtgaacaggaaaatgataggaaaattaataaaaaaatacaaagaaattatcatgtatctgatatttggtgtgcttacaactttggtgaactggttttgttatgcatttctgacgaagagtggaatggaaatgaatataagtaactgtatcgcttggcttgttgcagtattatttgcttttattacaaataaagtgtttgtatttgaaagtaaaaatatggaaatgagatttgtatgccgggaacttataaagtttgtaggtgcaagacttgcaacgggagccatagagattctcggactgccattgctctattatatcggtatgaaacagagtttgtttggggtggagggatttatggcaaaaatagttgtcagtgttgtagttgttttattgaattatgtattcagtaaactctttattttcagaataaaaaaggaaaattaagtttatatggatggtgtaaatagagtatggaaagtcgtacaacagtataatggtcagtcaatcatccctattattattttgataggtattctttttttggtagtcagagagaaaaaaaacacaaactatctgatcgtatatcttggcgtacttcttcttacttttaatgaagtaacctattatcttatccggaaattgggagaaggtatgacctattaccgctttctctggatgattcctatggtaattataagtgcgtatgtcataatgaaactgttcgaaatgatagacagccggaaaagaaaggtttttgcggcaggcatatgtgctttatgttttgcaatgacatcgggaatcagcatgcaacaattttttcaatttccggagaatatctatcaaatgccacagaatacggtagacgtatgcgatattattgagaaggacaggcaggagaaaagcccggttacggtgcttgcagataattcgattatgtatggtatacgtgaatataatgcgaatatccagaaagttatggaaggagatgacggatacttatggaatatgcttgaaagcaataattgtgatgtgagtggtttccttggaaaagtaattatcagtcaggctaatatcgattatattgtaattccaaaaggaaataatgcctctgcggcaatgctcatgagtgcgggcagctcttatatcggtaacagccaggactatgcggtttatcggacaaattatgatgtgattgcacagacggtgtatgataaatactatagtggggcatttcagtcggatatcagtacctactatgatgaggatgtggatataccggaagtgacagatggtggaagagagtacgtgtactatccagataatcatgtagcttttgtggatagagaaacacaggaatatacacattattttcagcaaaacaaagaaattcagatggtggaagagaatgaatatattttatgtgctgttgatgatagtaagggtactgtatcaaaggataccctggaaaaaatgcagaagattacagattcaggaaaagaaattattctttttttgaaaaaacccatatatcaggaaaatattcaggcagaaaacagagaggagatgcttggagaaaacagcaatcatacggatgcagttacggaagcatttattgatttggtaaaagctgagaatagtcacattgcagctgttttttctatgggaattggtgagtataataaacatatgttgaatgataaaatctggcagtgtatttgtggaacagaagataatgaccagggaactgtaataagaattcgataaaggataagtaaatttatgagcaatagaaagaaaatggcagtgatgaatgtattctctgcaattatgtattatgtggcaaattcgattattggattcattaaccgtaaggtatttaccgtataccttggtagtgaattactgggattaaacggactggtagtcagtgtgatttccatgttaagtctattggaactaggggtggcaagttctataggatacagcctgtataagccattagaagagaaaaattatggcgaagtgaaagcgattatgcagcttttcagcagactgtaccgttatattggaatagcggtggcagtaattggactggtgctgattccgtttttacctttttttgtcaggacaaccattgatcagaattatgtaattgcggtatatctgatttttttattagatgctgtattgtcttattttatggcatatcgccgaacaattattgtgtctgcacagaaggattatattaataaaaatgcagatacatttctttatattgtgactggaattttgcagatcattattatctgtgtgtggaaaagttatattgcatctctgatcgtgaaactcatttttacagtgctgaataacttgtatctttatataaaagcaggaaaaatgttcccttacctgaatgataaaaatctgcatggtgagattgaaaaagaagtcaaggacaagattgtatacaatgtgaaggcactatttgtaattaaaatagcaagttattgtgttgttggtacagataatattctgttgtctgcatttgcggatcttactgcggttgcaatttattctggatatacattgatcattggaattattaacaatctttttaacaggtcgtttggctatattactgctaatattggaaattatctcatcggtcataataaggaagaaatatatcagttttataataaactgaatttcctgaattatttgataacatcttatacttctattgcattgctggttttactgaacgaattcattggaaaagtatggttgggagaggactatgttttccccatggcagcagtagcagtgttggtatttaataattatcttcgcttttgtacgcaggcggctgaagcatttagaagtgcagcggggttatatagtccaaaaccattcgtaaaatatattgcacttttggaaggtggagtaaaccttgtggtatccgtagcattggcatactttgcaaagatgggaatttatggaatttttcttggaacatcggtgagtacaattgtttccatagtgacggttgcatggattaattatcgttttttatttgaaaaaccattgtatcaatatttttttgattttttcaagtatattatattagcaattagtatggggggattgagcctttttatattcaatatagcatatacgacacacacggtactcaatatatgtagtggattgatcattagttttattgttccgtttggcattaactttgtaatatttggaagaagcgaagaatggaaatactttactgccatgataaaaacggcatacaataaattatgagaaaaaggggaaatgggtacaaatgaaaactatttgcctggcaggaaagcatgacatagctgttaatgttttactttattgtctggaacactatgaaaaaaaatatattaaatgcattttaaatcgaaatgaaacaggaataaattcatggcaaaaatccttgaaatggtttgcggaaaaaagagatgtcgaaataatagaactggaagatgcttataatataaaagacatgatatttctttcgcttgagtttgatcaaattattattccggaaagatttcaaacaacagaattgtataatattcatttttcattgcttccaaaatatagggggtgttatacatcgattcttcctattttacacgatgagaaatatacaggcgttacattgcataagatccggtctggaattgatactggagaaataattgcacaggaagtggttgaaatcggagcaaatgatacctcgctggatttatataaaatattaatagagagcggtacaaaagttgtaagagagaatttgttgaagttaataaataacacatttacaactattccgcaggaaaaaataaaatcaacatattatagccgtaattatatagattattcgacattagaactggaagtacaacagacaggtaatcaggtgaaaaatcagatcagagcatttaattttagaccttatcagcttttgaaatggaaaaatgtcgagtatattgatgcagttatattagataaattatcagaggaaaaagctggaacggtattggaagacaatgaagtgtttactaaaatagcaacgattgattatgacacgatcctttacaaagataattttgaaagtctgatggaagcaataagaaaacatgataatgttttggcaaaaaaattgtgcagttcaaaacaactgataaaagcgcaggatactcatggctggtcggcacttacagttgccgtgtacaataataacatggaaatggcaagatatttaatagatgagggcgcaaatgagagggtattaaacaataatggaacgaatctattgatgtatgctaaagactgctatcttaattcgggggacaccacaatgtttgaatacatgcttgatttggacctcacaccggatatggaagattatgcgggaaagaatttgtatgattattgtatgagcgatcatatcaattatattggaaaatttagtatgaaaccggatgaattttaccgtaaaattgactaataataggacgtatagtataattctatttatgtcgtatagggaacggagatgttgaaaatgaatataccatttgtatcatttgaaaaaatgcataatgaaataaaagatgaagtacttgctaaaatgcaggagatatatgagaaaaactggttcattcagggaccggaggtgactgcatttgaagaagaatttgccgcatattgcggaacaaagtactgtgtcggatgtggaaatggtctggatgcattgtttcttgcattgaaggcatatggaatcaaagaaggcgacgaggtaattgtaccttccaatacatatatcgcaacggctttggcagtatcgtatactggggcaacaccggtttttgtagaaccggaagaaaagtattttaatattaatccgaaagggattgtgaataaaattacggatagaaccaaagcgattatggcagtacatttgtatgggcagccggcaaagatggatgaaatcaacgcgattgctaaaaagtatggacttgttgttatagaagatgctgctcaggcacatggagcagaatataaggggagaaaaaccggaagcctgggatatggagcagggttcagtttctatccgggtaagaatcttggcgctttgggggatgccggtgcatttgttacaaatgataaacaacttgcagataagatccgggcactgggaaactatggatcagattataaatatcatcatatttatcagggcaacaactccagacttgatgaacttcaggcaggggttttacgaattaagttacggcatctggatgattggaatgcaaatcgaatagctacagcggaaaaatattatgagggtattcagaatccggagattattttgccggggaagatggatgatgtaaagcatgtttatcatatctttggcatcaggtgtgaaagaagagaagaattggaaaaatatctccatgaaaagggaattggaacgaataaacattatccaattccaatgcatcttcaggaagcttataaagacttgaacatgtcaaggggaacgttaccaatagcagaagatatctctgcaacggaattaagcattccaatgtattatggaatgacggatgaagaagtaaattatatcatagatgcattgaacgcatttaagtagataattggagagtatatagatgcagatagttaaatatgtatttcaacagcatggcgacgagcggggacaattagtagcattagaagaatataaggatataccatttgaaatcaagagggtatattatatgtatgatactggagagggtgtgagcagagggcatcatgcacatagatcactggagcagatactgatctgtattcatgggtcatgcaagatattattagataatggagaggaaaaaaagatcgttccactggaaaagccatatgagggactttacattaaaaatgatatctggagagagatgtatgatttctcttccgatgcagtgctgatggtacttgcatcggattattacaaagaagaagattatattaggaattatgaagagtttcttaagtctattgaaaagaaataaaaaaaggttatgatgcataatggcagggataagaatatctctgtcgttatgtattatatttttatatgaggtagatttatgatggaaaataaactggtaagtatagtgatcgcaacttttaatgctgaaaaatatattttagatttattagacagtgtaaaaaaacagacttatgaaaatcttgaactgattattgcagatgattgttctgcggataatacacagaacataatatctgattgggtgacagaaaatcggggacgttttttccaggtggaacttttatttgcaaaggaaaatcaaggcacatgcaaaaattacaatcaggcaatgaaaagaagcaatggagagtatattaagctggttgatggtgatgatattttgcttccagaatgcattgaaatgcttgtaaatgaatgtgataagaagaaactggacttattgatcggtgatataatgtgggttcaggatgatggagtgacctatgcagagcatcatgaaaatatagaaaaaaaacaagcgttttacaagatggatgctgagcatcagcacagagaacttcttctgaataatgatattattattacggtaggtgaaatattcagaaaaagttttatggagagattccattggtttgatgaacagtatgatttattggaggactacccgttttggctgagaataacagaagagggtgttaagattccgtttttggacaagaaagtggcaaagtaccgtattagtgcgacatctgtgcgtaatccggaaaaaaatacatccatatataatgtgcgaatctcaaaagcttcaaaaagaaatttttacaatttgcgattaaagggtttgttaaaggaacgtcagatttctgtaatttgtagaaatatacgaagatatttgataagagatattgttattttcttgggaaattcaaatagtaataaaatatgccgtggattgacaatattagaataataggagaaatgcatgggggaagcaaatgcaatattagtatctgtattagtgatgtcttacaatgcagaagcttatattatagatctattagaaagtatactgcaccagcagtacgcagaattagaactgattatagcagatgataattcaagagatcgtactatagagaaaattaagcattggctgttaatgaatggtgggcggtttgaacgaacacggttattaacctctgatcgtaataacggtacagtacgtaatattaataatggactgaaatattgtaaagggaagtttataaaaattattgcggcggatgatatattaatgccaaattgtatttcggacagcgtgcaggtgtgtctggatcataactgggagatagtaattggaaaggcagaatgggttcaggatgatggaaaaagtcctgcactacatcatgagaataaacgtgcagaagatgcattttataaaatgagtgcaagacagcaatacgccgaattattgaaacacaatgatctgatatgctcaccagccgcattttataaaatgagttttctaaaaaaatatcaaggatttgatgaagcatatacattgattgaggattatcccttttggttgaagataacggcaaatggagatcatattaatcattttgatcatgtagtggtgaaatatcggcaaagtacaacttcagcaacaaatccggagaaaacagttcagatttataatgcccgcataacaaaagattctaagaagattttttacagacaaagaatgtggggacttctgaaaaatgggcagattaaaattgtagtaagaaatattcgaagatatttcatacgtgatcttgtgattatgttaggaaattccagtaaaaataaattatgttatgcattaacgcgtttcgagtaaccagaaaagaattagaggaagaagaatgggagagataacacttgtaacagacttttttgacataggaagagggcaggataagaataaggatttacgaagaactgcacagcggtattttgatgaatttaaaagatgggcaagaatccaaaatacgttggtagtatatacggattctgacagcgcggaaatcatcaaaggaataagggcagaatacggattgggagagaaaacgattattatacagattgataatttgtttgaacttgtaccaggtcttttgccaaagctggaaaaaatatctcacaataaagatttcctgaacttcagatatcttccggaagcatcttccaataatccaaaatatgattatctgtggatgatgaagtactatttcatgaatgatgcctatgaaagaggattattatctgaaaatgttgtatggatggactttggattcgaccatggtggaattacttacagtgatgcggaggactataattttctgtgggaatatgattttaagaataagatacacatttcctgtctgcatgatcctgattcagtaataggtctgcagagtctgcagtttcaggatgactgtgtgatgggatgtatgtatgggttatcaagagaactggtgccgacattctggcatttggtagaagatgcgatgaatgcacttcttatgttggattgtatggatgatgaccagcagcttgtgcttatggcatataaggcaagaccggaaatatttgaggttcatgttacagattggcagatgatcatgaaagagatgggggcaacacacatgaaagtcagagaaaagctcccaatgcaggcacaggcagagaatccatataaaaaaatgttgagaatcgcagttcgcaagattgtaccgaataagaatgatccgaaacatgcttttgcgaagcgatgttataatgcggcaatcagagtgtatggaaaataacggaaagtgaatgaataagatgaaattatctttggtggtaccatgctataatgaagaggataatatccgggatttctatcatgcagcaaagcatgtttttgatgcggaagaatatgaatatgaaatgattttcatcaacgatggaagtaaggataagacacaggaagcgttagagagcgtatttaatcttcacgaagcatgtgttgtcgtggaaactttctccagaaattttggaaaagaagccgcaatttatgccggatttcaaaaagcaacaggagattttataacggtgattgatgcagatctgcaacaaagaccggaaacagttgccagaatggtgaagattcttcaggataatgaagaatttgactgtgttgcagcatatcaggagaagcgtcaggaaggaaagcttgtcagtaagttgaaagatatgttttataaaatcattaacaggacaagcgagatagaattctttcccggcgcatccgatttcaggacatttcgaagaccggttgtagatgctgttttgagtttgccggagtatcacaggttttctaaggggattttttcctgggttggattcaatacctgctatattccatatactgcggaaaagcgtaatgcaggagaaaccaaatggtccatcaataaattattcagatatgcagtagaaggttttatctcatatacgacatttccattgaaaatcgcgacaggactgggattatttacttcattatgtgcaatcatctatttatttgttgttgtgatacaaaaattatgcatcgggaatccggttccgggatacccgacaattgttgttctgatattattgcttggaggaatacaacttacgatccttggaattatcggagaatatcttgcaagaatgtatatacaggagaagcacagaccaatctatatcgagaagaaattgttggattataaaaagaaccagagcgaagcagaagaaaaagacaggtaagaaaaaggagtatactttgggcaagagagtattgattatcggtggagcaggatttattggaacaaatttatcgaaacatttgataaagagtaatatggaagttttctgttttgatatgtcagtacctgcgaaaaaggtagaaggtgttcactatatatgtggagatttttttgatgactattccctgatggaggcattggaggggattgattatgtcgtacatgcacttagtacagtgaatccgggaaattctaatgaaaagtatctgcagggatatgagagagatttcatccagactacaaagctttgtaaaatgatcattgataagaaaattcgtatgatatttttatcttcaggtggaactgtttatggaaatcaggaaatacagccaatcagcgaggatgcacttccacgaccaatcaatcattatggaaatgtgaaattgtgtatcgagaataccattcggacatttaattatcaggcacatacaaagattctgattgcgagaatatcaaatccttatggcccgggacaggatttcaataagggagtaggttttattgatgctgctttgaagaaaacgattaaggaagaaaaaattgaaatctggggagatggaaataatatcagagattatatttatatcgatgatgtgtgtagaatgttaatggttctgtttacttataatggggaatttgatacattcaatctcagctccaatgttggaacatcacagagagacattatagaaatgttacaggaaatggggttaaaaccacaagtggagtatcttttagccagaagtgtcgatgcaaaaaagattatactgaataatggacggatcatgagcgttcataagaatgcattaataccaatcagagatggtctcagagagtattatgactggttgttacagaaaaaaatctaaacaaatacaccgaaacaatccaagttaatgaacagattgtttcggtgtatttgtttactgcatttatttatcagaagtatctggataagtgacataaattttattcaatccatagtattttgctacatatacatttggaaatggttcgttagaattctgaggattgagatctaatagtccatatttacagctatactttgttgtagaagtgatgatgggaaccccaatcgtcagttcgccagaaacaatggaattctcgatgcgttcatttctggcagtctgttctctgtgcacacggtaaatatcgtatgaaccatcccaataagccataacactgctgatgagaagatatacgcatacacacaatgtgagacattccagatgactgttgcgccggagaatctgaagcagctgaacaataccgataagaaggaaaacaacactgtttgcaatacttctttcaggtaaatagcttgcaatgatcagcattgccgttgcaacgaagctgataaaaaggtaggcaatcgcaatcagaatctcatttttacccattttgtgataaacagcaatgcaaagtaaaatgaaaaacaggatcagaggatatttgcacatattataataagtggtgaaaagatcaattccattttttgcaagaacggataaggtaaggttatcggaaaacttcgcactgccggaggggctgagtaataaaaccagatagcccgctgctccacagatgattgggaacacatacgacagatatttccggatagtcttatgttgatacatcgtgacgcacataagaagaaatcctgtgaatataactgaaaaggatacattctcagaataattaccaaaaagaaatgtgaacaggcagaataaaatcagcttccacttcttatccaatagggactttccacgcagtaacgagatataaatattcagaaacaacagagcaaacagataactccacatataattaatgcagccggtcagccagagaaacacctgaccgtatgcaggcatatataaccaaaacagggtaggcactgcaaaaaacagaaggatactgaatgatttcttacttgcagtaatacgtaaaacaaaagcgataaagaaaacaaaaagaaaggcattcagcacatcaaaaatgatttttggtgccataagaaacagcattacaaaaaagtgtgatacaacacgtccattgccatattgcatataatgcgtggcaagggatggaaaaatctggaatacagaagtgatccgttcgccattgccgagattatacatataagaataatcatcggctgcatatggtgtccagtaattgaacagaaatgcagtcaggaataaaatcgaaaaggaaataagctgcatcttagtcagacatttaaaatattttttcatagtatgatcctcgtttattaattataatttaagattagatgggagctgttgaggcccgacagaaaatattgtagcatataggtaaatatctggcaaatatcatgtcggctggaagagaaaactattacaaatatacaaaaaaggcaactagcgttgtaatcgatttatatttgtggtaaaatcaataaggttatttgtcgataaaagaacttatcataaaggggattgttatgtatcgtaagagaaataaaggatggctgaaacatctggattttgctgtccttgatttaatgtgtatgcagatttgtctggcactggcatattttggaagacatcgagagcttagcagattatatagtgattccgtttatcagaatgttgtgcttttattggcagtatttgaatttgtatatcttttttttatagatggatatcgggatatcctaaaacgcggttattatattgagctggtatctgcggtaaaagaagtatgtcttctggaaatgctgcttgcattctatctgtttgcagtgaagtctggagatgatttttctcgaaccgtattgtttttgtcgggaatctatgaattgataggtggatatctggtgcggatcttatggaagaagcatgtgatgcgccggcagtcgaaagaaggagaaaattctttattattagttaccacgtcagagtatcttgagcaggtgttggaaaatgtgcgcagcaataattttcaaacctattttccggcaggaattgtgctgatcggcagagaaaaaggagcatcagacacttatgagggaatcccacttattccagagccagagatgacagaatgggtatgcagaaactgggtagatgaggcgttgatcgtattaccgcaggagcagcatttcggcaaagaatatatggaagcattctcggagatgggaattgtgacacattattctatcatgcaggatttcgctgatgcggacaatcatcagatcgcagagaaagtatgtggatatctggtactgacatcagggatgcagctggtcagtaaccggcagtatctgaccaagcgtgtgatggatatcgcaggaggcatcgcaggatcactcatcacagtaattcttacaattattttgggaccactgatttatatcaagtcgccgggaccaattttcttcacacagaaacgtgtcggaaagaatggcaaaatgttcaagatgtacaagttccgtacgatgtatctggatgcagaggaacggaagaaagcacttatggagcagaaccgtgtggcagatggcatgatgttcaagatggaagatgatccgcgaatcatcggaagccattttgatgcaaatggaaagtatgttccaggaattggaaatctgatccggaagctcagtctggatgagttcccacagttttttaatgtactgcttggtgatatgtcactggttgggacaagacctccgacagtggatgaatatgagaagtataagttacatcacaaggcgagattgtcggcaaagcctggaatcaccggattatggcaagtatctggacgtagcgatatcacagagtttgaggatgtggtaaaattggatacggcttatattaaggactggagtattgggaaggatttgcggattcttgctaagacggtacaggtagtgttgatgggaaaaggaagtatgtgatgagtgaaaaaaagtaaatgttatattggttagttccggcatatagaacatttgaagaaaacggctatcagaatatttatctggttttgttctttgttaggaatgaaatatatctttacctttagcaagttagagggaaagcagatttaatgaaacattataagactagggaaagtgcattattactaatcaaagaaaaggaatcctatggtggaaaagataaaagagagcaacagtacggttgtaaagaagctaaataataaagcaatcaaacatatattcattattggtgcaaaatcaatagggctttatggaggatacgagagtttcgtattaaatctattacaacagcacgaaaacaataagaatcttcagtaccatattgcctgcaaagctaatggtggcggatatatggatttaaagaaacttccaggagcggtcagtataaataacattgaattcaaatattgtagtgcacattgtgttctaattccggtgcccgaaaaaataggagcagcacaagctatttattatgatatcaaagcattaagatgggcatgcgactatattgagaaaaaacaaatacaagcgcctattatatatattctggcatcaagaattggaccgtttgaaggaaaatatgttcgtagagcacacaaattgaatggtcttgtatatcagaatccagatggacatgaagactggcgtggaaagtggagtctcccaatacgaaagtattggaaactttcagaacgtttggcagtaaaaaatgcagacttagtagtgtgtgatagcaaatcaattgaaaaatatataaaggatgagtacagtgagtatagtccaaagacaacatttattgcctatggtgcacatgtaaccacatgcacactatcagatagtgataaaaagtatactgcgtggctcaaaatgcataatctgaaagacaagaatttttatacagtggtagggagatgcgttccagaaaataattttgaaacaataattcgagaattcatgttgagtggttcagagaaagatttggtaataataacaaccaataatcctaagatgctaaaaaaaatggataaaaaacttcattataagttggataagagaattaaatttgtaggaacagtttatgatcaggaacttttaatgaaaattagagagaattcgtatggatatttccatggacattcagtaggtgggacgaacccaagtcttctagaagctctaggggcaacaaagctaaatttactatatgatgtgggatttaatagagaagtggcagaagatgcagcattgtactggtcacttgatgaaggaaatttagcaaagttaattgatatagctgataagttgccggaagagaagatagaagaactgggaaagagggcaaagagaaggatacaggaagagtactcgtgggaaaagatagcatctaaatataactctatatttctataaaaatggcatattgtatatgagtgatttacattttgaagggggtgggtttgtttgaaagtagctcttatatatttatcaaattataaagattggccaatgggcggtatgctaaattatataaataatattattcctaccttatgtgattctgaaaaaatggaagtggatatttggggggggacacgtggcaaggaaagggctggaaatttttatattgggaacagagaatttattcttaatagatatacgtcattttatacggaacacaagattcttcctaattttgttttgagtttttttggagcattattaaatagttttaaatttagaaaatatgatgtgatttattcgcagacgtcagctacaacaattgcacttaagatcacacatccatttaaaaaggtaattcatcatcagcatggcttttcgtataaggacagaccaggaattccaagaaagatgttgtgtttcggtcatttgatagcacaaaaattggccgatgcaactttatttgtggcaagtgacaaagaggttaatgaacatagaaaacaacatagatgtctaaaaaataagcatttttatactattggaagtccaattaattataaatatattcatgatagaatgttgaatattaagacaaaaaaaactaacgtcacgcgttttgtatatacgggaagaatagatgagtggaagaatatagaattaatgatagaggcctttgatttattcatgaaatccggttatgaaggtgaacttacaataattggagatggaccgctattagaaaaaattaagcataaggtagatggactgcagtgttgtgataatatctgtataacaggaagaaaagattttaatgaaatagtagaatatttgtgcagaagtgatgtttttctattccctacaaaaggagaaggagtatcactatctttattggaagctttttcggcggggttacctgctattgtattcaatgttaaaggagtaactgaatttgtcaaggatgaaatatcaggtgttatagtagaaaaaatgacaatatgtgattatgtgaatgggatgataaaaatatcgatgttgtatgaaaacatgcgagataattgtattgaaatagcatctagatatgaaagcgacataattgcaaataaaataatagatattatattaaaggaattctcatgaaaataatttttagcaagaaatatatctggatatatgtgtatttatatttaatatttcaaactacaatacaaaatacaacacaaggtataattaataaaatagttacatattctgatgatttaatatgcctaatactacttttttgcctgataattagattgttaagaaagagaactgttgttgaaggtaaaggtgaattatttgcaatagtgttttatacattatatctcagtataggtgttatttgtggaagtatgcatgattatcaaaagataaggtatattttacttgatatgtttacttgttcaaaatttataattgtatattttgcttcaaaggtattatctgaaaaatatattgatgatgattttttgtttagtttaaacaaaggattagagttaatggcagttgtattatttgtgcttactttacatgatttgttgtttactcctttttttgaaaaatcggaatatagatattttacaaattcgataaaattgtttttttatcatccagaagcattagctagagcctgtgcaggagtaatatatcctcttgcatataatatgaaaaaacagaaagaaaatattatttatatattgatgctttgttttgtgatgttttttacatttcggatgaaatcagttgcggcaatggttatttttttgcttttgtatatttatcggaaatatatcagtggaaaaaatacagcattattatttgcagttgctgtactaatttgtttagttatcggtcgaggtcaaatgaaattctattttagtatgccagagattggaagaacaaaattagttacagactcggtaacattagcaaatgagcattttccattagggactggatttggatcgttcggatcaaatgcagctttggaacataattccttactttatgaaaatatgggatattatgacaagaataacaaatgggcagttaaggaatatttgaatgatgcattttggcctattgtagttgcacagactggttggattggaacagttttcttttgcttagctattttatgtttattattgaagggtgttaagctatataaaacagagtttttttcgggttgggtaatactgatggttttattatatgatttagtatctactcttgggtcatcagcattctatcatcctatgtctttatcaggttatatgtttgcggggatagtaacatcacaatatttaaatacaaaaaggagtgtaaaggagaagtgaaagaaaaatatgtattagacgtatattgtgtatccgacttcggtggtgcggaaagacgattgattagagtttataatgaaattgcaaaaaagtatgattgtgatattgtttttagagggagttcgaaaaaaaagattttggaaatcttggagaaatcggactgtaatatagacaatataaataaagtgtattattttagacatagtattttaagtttgctatatttttgctttgtaaataaatataataatatacatgtatttgacgtttgtggctataataaagcacttttgtcaattatgaaaaagaaaggtataaagacattattaacgattgcatttcaaaattatgcatacggaataatagatgacaaaacaaaaaaaatgttaacggaacatttagatttggcaaccaaggtagatgtactatttcctgcgggagagaaatatctaaaagaaatatctaaaaatagcaatgttacagtaacaccaggaacatttacaaaaacagagttgtttgttccgataaaaaaagaaaaattaatgatttacgttgcaagacgactagaacatgataaaaatgcatcaatgttaattgaagcatgtgatatttgccaagatgatatacgaaaattcggttataagattttgatttgtggcaaagatggtgaagaagaaattttacgtaggaaaatctatgaattccaccttgaagatatattagaaatgccgggctatgttgttacaagtactgtattcccaaaagcagaggtatatattagtattgatttgattgacaattatccatcacagacaatagcagaagctgtttctagtgggtgttctttgatatgtacaaatgtgggatatagcaaaatgtgtggaagcgaggaattttcaaaatatataaatgtggatgcaacggagttggcaaatgctattcgtgaacaaatgaaaaaaaatattcaacaaaagaacgaaaatattataaaagcgagagaatacgcactaaaatattacagcattgcagcaagcgcagaatatttttcaaaattaattagaggataggaatatgaaatatggagtatggtggttgtttacattttgaaataaataaaaaaaacagtggttattatgcagagtatgaatcatcaatgattgatgtagattgtggaaggtctgctttgcagtatattcttgaaaactatcggtttcagaggatttggcttccaatatataattgcccgactgttgaaaaaagaataaaagaaatcagcgatattgaaatttgttggtataatatcaataatttatttttaccagatttggagattgaacaattgaagagtggtgatgttttactttgggtaaattattttggaatgatgcctgattcagtaattgactcagtagtggatctgcagaattattgtgatgttcgaattatagtagataatatacctgcatatttttcgaaaccaaggcttaaggcgtttaatatgtattcatgtagaaaatttattggagtacctgatggtggacatgtaatagggaatagtgtaataaaaactgaattacctttatattctacagctgataattattattatcttctgaaagctatagaaacaggttcaaattctgcatatggagattatcaggagagtgagaagagatttttgaaatcaagaacagcttttggaatgccaaaattaacgaagagaattttagagagcgttgattatgaaaaaataattattaaaagaaaagagaattttcttgcactacatgaaatattgaaaaatagtaatcgaatggatattaatataagtactaatacaccttcggtgtatccttatttaacaacaagtaagcaattaagagataaactgattgataataagatttatatatcacgtttttggaagcatgtcctaacaaatgaattggcaaatgattttgaaaaagatttagcagagtatttaatacctcttcctattgaccaaagatatgaaagaagtgatatgaattatatagctagtaaggtaatagaacttgaaaggatatcagggaatgaatagagaactaatgaattcgccagaagaaaaggcactttatgacaaattttgcgagaagaattatataccgatattttcaaagccatggtggcttgatgcagtatgtggcaaagataattggggggtacatgtattagagaaaagtggacaatttttaggtgcaatgccatattatgtggaaaatagaaatgggtatgaaattatcacaaaggcacaccactcacagaataatggaatattaatttcgtatttgccgaatatgaaatatgtggctatgcttgataggcaggaggaagttattaatgagatgtgtgattacatcgaaaaattaaatgtagataagtatgagcagcagtatcattattcttttacaaattgtctaccttttaaatggcgtggatatgaagctatggttcgttatacatacgtaattgatgatactagtgacatggataagatttgtgcagattttaaatatattgtgcgcaatcagataaaaaaagcagaaaaggttgtaactgttaaagaagggatgaatattgagaaattctatgaaataaacaaactgagttatgatagacagggaattgaggtgccgttttctttaaaactattttctagaattgaagaatgttgtcttgcaaatgaatgtagaaaaatcttatatacgcaagatgaagaaggaaacatacatagtgttgcctatcttgtttgggatgaagaatcattgtattttcttataaatgggattgatacagattatacatggagtcaatcaaattctcttttaatcagggagtcaattaggattgcccataatcttggaaagaaatttgattttgagggaagtgtattgcaaccaattgagcatatatttagaggcttcggagcagtacaaaaaatgtattttagaatctataaatcttttaataaagaaatggatcagagtaaagttagctcctgggctaaaaactcagaagttttttaatatggaggaaatgaagatgtcgatgaaagaaactcttttaagtaaaattgataatcgtgagatagttgttggcgtagtgggattaggctatgttggtttgccgttggctgtagagaaagcgaaagctggatttaaaacaataggatttgatgtacaaagtcaaaaagtaaagatggtcaatgatggacacaattacattggagatgtagttgattctgatctgaacaatttggttaaagcgggaaaacttcaggctacaacggattttagttttgtgaaggatgtggattttattgcaatttgtgttccaacaccgttgaatgcccaccaagaaccggatattagttttgtaaagtcttcagcagaggaaatatctaaatatttgaagccaaatacgatggttgtacttgaatcaacgacttatcctggaacaacagaagagttaataaaacctattcttgaggaaggaagcggattaaagtgtggtagtgacttttatttagggttctcaccggaacgtgtggatccaggtaacttagtttataaaacaaaaaatacgcctaaagttgttggagcaataggtgaagacgcaacagaggtcattgcaaaaatgtacagtgcagtattggagggagaggtttatactgtttcatctccggcaattgctgagatggaaaaaattttagagaatacatatagaaatatcaacattggactagtaaatgagttgtctcgtctatgtaataaaatggggatttctatatgggaagttatagacgcagcaaagacaaagccttatggatttcaggctttttatccgggaccaggtttaggggggcattgtattcctcttgatccgtattatcttacatggaaagcgcgcgagtatggttttcatactacacttattgaaaacagcatggttataaatgatagtcagccagagtactgtattgaacgcgcaatgcatattcttaataaacataaaaaggcaattaatggagcgaaagtacttgttctaggtgttgcatataagcaggatatagatgattatagagagagtccggctttagctgttattgataatcttaataaggttggggcagttgttgagtactatgatccatgggtgtctgaatacaaacgaaatggacaagtgtttcacagcataaaagagattaatcccgaaattgtagcatcttttgatcttataatggtaacttgtgcccactcaaatgttgattataagatggttcaagaaaatgcaacagcaatttttgacaccaaaaatgtcatgaaggatatttctgatagggagaatattgaagtactttaatataatagatgatgaattcgccaaataacagtcgaacatacggttttatcattatgtgtgccagtgtttttcatggcatatcagaaatcatatgcacatgaagtgataggctaatgatacaaaaaatatatgttggctaggagtggttacttttctaatgccagatgtagttagcattttgtgtctgaaacttacaaggaagatgttaaaattatatcaatcgtaaagttaagttattatggaatattttatgtatggatttccgacaattatgaattcttcctgaaaagagcagataggattgctatggtaggtattgtaataatttgttagaaaaaaatggttttactcttgggcaatgtttataacgttattttatggagtgataatgaggtggggaattttttatagatgctattcattgtctattattagatggtgcctttggttgtggagtgtagttgttatttaaattatttaatatataaatcgatattttgaattgtgaaaaatagtgcatactatgggagaatagatatgataaaatggtttcgattaatgcgatggttatattatcataagttgaaattccttgcgaattttattcggaaggtaatacgtctttattatagttgtgatatttatccaacttgtcaaattggcaatggaacaactttttatcatcaaggtttaggttgtgtgtttcatgaacgtgtagtgattgataaggattgcaaaatatatcaaaatgtgacatttggtggaaatggtaaagaaaatcaattgtacccgggagcaccgcatatatgtgaaggagctactatttatgcaggagcctgcattttaggtcctattagagtcggtaagaatgcgatagtaggtgctaatgctgttgtgttgaaagatattcctgataattgtgttgctgtgggggttccggctgtaattagagagaagagcagtgatgtattataatatttaatgaaaagtctaatttgataatgctttatgatagacatacagagtagcaaagcaaattggtggctttgagttgattattaattatgataatatattattataaaggaagattggtacgaggaataatgttttatgagtagcagagaagttaaaacaccatattacgatttttttaggatagaaaaagaaatgaatcttttctctttaaaatataaagaagtttattattggcagttattaagaatgggcctattaaagaaaattacggttaaagatttacatattatatctgctgataaaaatagaaatttcaaaaatgaaataataaagactttcaaagaagcaaaaagaatgaaaaaaatatatttagaaatgccaaaggctgatattgttcagattcgtccatgtgttacagtgacaaaagataatcaattagacgatcatcagtttgattatatttctttgaaagacagatatgcggttttggatttgtatactcttggaaattatgtcaatgtcaacgagtgtgtcgaatatgatttggcacaagcagagaatgaacttattaaatggaaaatcaagcgtaagttatttggagcgagccatcttcccataaatcaaagaaaagaattagaaatttttttgaaaaaaataaataaaatttatggaacaaatttttctatagagtcgttgttacatgaagcacaatatgcaatacagtgccataaagtgtataaaaaatggtttcagagatatttaaaaaaaatttctcctaagttaataatggaatatcctcattacgatgagcatatgtttgcagctaatgcagctgctaaagaattgggcataaaggtgatagaaatgcaacatggaagaataaatgctcatgaggcatattggtatgaggatcaatcacaaattggtaaattgcttccagattatttcttcacttatggagagtggtggaatgaacagattaacttaccggagttctgtaaagttattccggtaggaaatgtatatttggagaaacaggtggctagatataagaaagaaaaaaaagatcatttagttatttctgttttttcaaatccgcaaaatggaaaaacattatcagagtttatttatagcatacaagattattgtttagaacagaatgttgaaattttgtataaattacatccaaatgaaaataaggtgtggaggacagaatatcctaggctatctgaaatgaagaatactaagatttatgattcgggtagtgtgtatgatgttttgtctcaatcagatgtcacaataggcataaattccaccgtgttttttgaagctttggcgtatgaagacttacagatatatatttatacaataggtgattatgaaggtatgaaaccgttgattgagaataaaatggccacagcagtaatcacgccagaagagtttttagaaaagatttctagaaaggagacctataaaacaatatcagatgtaggtaaaagtttatggaaagataatgcagaagataatatatatgaaaaactcaagaatattatttgatggttaatgcttaggtgttcaaaaaattaaagtggtcgttttttatggatgtaaaaaaatactaataatttcaaatatcataatgcttttaaattactgaagcgcaaggtaaaaatatattagaaacactgtatgaatttttagacgtaaggatttcgttactgacagagtaaagagaactaaagtaagaggtaaaagcctcataaattaagaagaaaggaaaacgggtggtgacaatcaaccgaaaaattccacatttgagtaataaagcaaatagcaataaactaattttatataatactttaagtacaataatattatatgcaattactttttttagtgcaccaattttttcacgattattaggagttgataattatggagttgttcaggtatataacacatgggtatctttttttgttgtaattcttggattgtataccagaggaacactggcaattgctaaagtgaattttgaagaagatgagtttaaaaaatatcagtcaagtgttttattcttgtcattaattggtttccttgtgattctgattgttatgttagtattttgtccagttattgttgatttttttggactagggcttggatatcttattataatgttattacagagttttggaacgtactgtgtgtattttatcaatactaaattcacttatgaaatgcaggctcaaaataaccttgttatatcggttacattagcgctcattaacttcggattatcattttttttgataaaaatattagatggagaacatttatatactggaagaatattaggaatggcaatcccatatgttacagcaggtattatcattattatatatatattcaaacagggaaaaacattttacaataagaaatattggaaattttgtctgcctttatgtttgccgttaatatttcatggtatatctggaataatatgttcatctagtgacagagtcatgattcaaaagatgattgatgttacagctgttggtatatatgcgttagcgtataattttgccaatataatggactccatatggggggctttacataattcatgggatccatttttctttgaatatgtaaaaaataatcaatgtgatgaattaaagcatagatcaaaaaattatataaggttatatagttgtttatcaataggatttatattacttacaccagaggtatatagaatatttgcatctgaacagtatttggagggtgcatcaattattccaatagttgtgttaagttcatatgcgatatttgtatatgcatttgctgccaattatgaattttgttataagagaacagatatggtagcaataggaagtgtgattgcgggaattactaatatagtcttgaattttatacttattacattgttaggatatttaggtgcagcgattgctacagttttatccaatatagttttggttatagttcatacctgttttgctaaaaagcttgttaaagataaatgggtatataatgttagaatgtttgcccctgcggtaattggtctgataatagcaatggtattatattatggattttatgatatctggtttatcaggtggggatgtgcaataattgttggagtgtatatgatttggaatatttataaagagaaaactattttttaagataaaggatgaaagaaatagtagaatgaatgagttacaataataatgaggtatcaaatgttgccagattagtattgagaacttgggttacagttcaatgattaattaaactctaaagttaaaatgcaacattatattcttgataagtattatttgagaaagctttgattaagtacatattggattgaataatattaaataatcgtagaataattgaacttaactcaagaaaatacaaggagttaaaggcgttatggagaaagaaaatggagtaacaaagaagataatatatataataagtattattttggtcgtagttttttgtactatatttgttattgttggaattgacgctattcagcataagcatataggatttgatgaggcatggaacgcatctgtggcagcgaatgttgcaagaggacatggatatatggaatcgtaccaatctccaggacggttgtttccaactgtaataactacaggtcaaacagtattattaccaacagcaatactttataagatattcggggttaatcttataactagtagtataattccattattgtttggtatgacaagtattattgttacatacatatttatatttatgatactgaaggcatatgcaaagcgttatgaaatagatgacatagctattccgtttatatcggtcatactaacgatttttgacgtattatctcgcagacaatataatacattaagtacgggcttacttggtgaaacggcagccttattttttatattaatatctggaatatgtatttttgagttttataagacagaaaaaccaatatatatattgattgcaagcggattacagatagtagcattaatgactaaaccagaagtcattatgattaatgtttctattattgggtgtgtaattataacttcagtagcattaaaatcttatagaacagttttatggacggcgctaggttgtataataggtttggttgcgacagatttatataagtttataaagatgggtgcatctataaggaactatttagggtggtgggatgacgaagtacgatatatgtttcaacaatcgtcaggagttgacgtgagtgttgacataaatgaaaagataaattttttgtcaaaagatttatttggcataaacgttttttcttgtctgcttctcatcgttttaccagttttgatgtatgggattctacttgtttatattatggtaaagaagaagagtgttccaccagaaactttaacaatagcaattatgggtacagcaggggcttcattggaagtgtttttcttgttacttggtggtaggggattgatattcacaagaagacattttatcaatgcgtatatagtaatgacatgtgtatggattgttcttgttgtagctatatttctgatttggaaatatgctaaaaaatgtatgggtattttgggttatgtatgtatcttaattatagttgctatagtattttacacgagttgtccatttgattttataaatgatagtattggtttatatacaataaataaggaagatgagagttctttgacattaatgaaacaattaatggtggaaattgattctttaggtgatgacatatcattgtactcttatgcttggtggcaagaacctaacgtgactctgttcttggataaaacaatgaaagatattaatcaaacttcagttgaaacaatcgattttgagaagtcttattttattattggacagtatttttatggtgtgaattttgaagagttttctgaacagatgaaagaacgtggattgggatttgacagagtagataatatacatcgggaagactatggactgcaagataattactccatatttaaaatagtaaaagttgcggatgaaagagattgactatatggcaaactgataaaatactttttaaagtatagaaaagagggattatggaaacgatggatattttgtatattgttatgcctgcatacaatgaagaggcaaatattgagagggtcgtcgaggagtggtataagctattaaatggtaaatctccaaagtcgagattagttattgctgattcgggaagtacagatagaactcatgaaatattgttagagcagaaaaaagaaaaaaaccaattagaaattttgaatgattgtgatcggcagcatggtccaaaggtcattgctttatatgattatgctataaaaaacggagcagattatatatttcagactgattcagatggacaaacaaatgcagatgagtttgaagatttttggaagaatagaaaattatatgcaggtatatttggaaacagatcgaatagaggcgatggagcatcaagagcatttgtagaaaaagttgtttgtatattgttaaaactatattttggagtaaatgtgcctgatgcaaatgcgccatttcgattaatgaaggcagattgtgttaagaaatatgtgtataaattaccacaagattttaatattcccaatattatgatgactacttattttgctaaatatgaaaaaaatataaaatttaatgaaatctcgtttaagccacgacagggcggaataaattctatcaatattcctaaaattatagggatagggtggaaagcattgagtgattttcataatctcaaaaaaaatatgtgacacaagaaggaaaaactacaaatgcaagttgattcatttttatttgtgttggtatttcttccagttgttgtttttttatatcatgcatttggaaaaaacaaaatgcgatataaaaaagggttattggttatatgctcattacttttttattcatattcaggatgcaagagtgtagcggttttaatatgtagtttgggtattaatatagtgatatgtgtttttttgaagaagagcacaacggcgcatataactaactttattttagcgactgggatagtactgaatttactacttttgggatatttaaaatatactaattttataattcaaaatataaatgcattttggaatcttagcattactgaaaaaacaattattttgccggccgggataagcttttttacttttcagcaaattatgtttataatatattatgctcggaatggtgagaaaaatattggttttgtagattatttggtatatgtgttatatttccctaaattattaatgggacctttagttgatcctaagagctttttgaatgaattgcaaacagtaagaggtgttgactatagaagtattgtagaaggcatacaacgaatagttgtggggttgtttaagaaagttattgttgctgaagcaatgattaatgcagtcgaatggggaagtaattatatttcagagagcacagcgctggatttgataattgtatcatttgcctatacaatgcaaatttatttcgatttttgtggatatagtgatatagcgattggtgtatcaaagatgtttaatatatatttacctaataactttgattctccgtatagagcgacatctattagtgatttctggagaaaatggcatatatcattaaccaattttttgacagagtatgtttatattccgttgggggggaatcgaaaaggaagggcaagaacatattttaatattttaattgtgtttttggttagcggaatatggcatggcgcaaactggacatttattgtatggggaataatctatggtatgcttatggtagtagaaaaactactgtatagacagataaatcgtataccgaagataatagggagaatttatacgttatcaattgttaatattttgtggatgtttttctggttagattcaatagatgatgtactttacgctataacaaagatatggaaaggtgtattttctggtagttgggttataagcgaaagcttaaagcaatgttttttgacaaaggaaatgtcagcaatgatatatttgctgaacaacgattatatcagcaatcacggaacgagtttagcaatgattgttgttgtttgtgtttcaacaataatatgtcagtttccaattaattcaaataatataaagtataaagccaataccagaactgtttttactacggtcatattagcaacatggtgttttattagtatgagtgtacgtacagcaggttttatatatagtggattttagagatgaatgatattagagaaaaaagatggatagtattatatattttttttcaagtaattgtgttattgtgtatttcatttgtagttatttatatagacccatattttgcctatcataaacctaatacaaatgtgtttaaatataatttaggtttaggaaacgaacgccttgtcgatttaggaattgcgaaaaattttgactatgatgctattatattgggcacgtcgatgacagaaaattttaaagtaactgaatgtgaaaacatatatggggtagatctttgcgttaaaacgccagtgagtggtgcaaagtataatgacgtaaataatatttgtgaaatagcattaaaatatcatccagatttaaaactggtgataagaggactagatacaggatttaaatacatgataccacaaaatgcaacagaagatttaacatatccctattatttatttgatgaaaataaagttaatgatattaattatctattaaataaggatgttcttattgattattgtctgaaaatgtcggtggaaagaatgcgaggaacagatgctggaataacatcatttgacacatatgcaaattgggcagaattatttccatgtggtagagataatgttttgaatgattatattcctgaaaaaattattttagatggggatggtatttctgagattgaacaaatcataataaaagaaaatatagaagaaaatgtagtgtcgttgtgtgaaaaatatccagagacgcaattttattttttttatcctccatatagtattgtttcttgggcagaattaggaaaaaaaggtcaaatatataagcaaattgacatgcagagatatgcatcggggcttattttgtctgcaggttacgaaaatgtacacttgtttgattttgcattgatgccaggacttatcactaatttggataattataaagatgcagggcattatggtgaacatataaattctctcatgttgaagcttatgcataaaggagaatatgaattgacaattcaaaattatgaatcatattatgaagaactgtacagagagataaaatcctttgagtttgagtcgttggatgaataaaaatagtatagaactttggcattttccttgaaagctgagttactatactggggatatgtttgctttttttaatggaagttgtcagttggctggaaatagttttataaaatatatgtcgagactttcgtatccactatatcttaatcataatgtgtttagagaattaattccttgttatatagaggattttcaataatagtatatatttgctatttagtattggtgacactttattcaatgttgacaatgcttataatagataaaattacacatataaaagaaaggaaatattaaaatggaaaaaacaataacagcagtggtgccagtaaaaggaaatagttcaagattaccaggtaaaaatattttaccatttggggattcaaatttactgctacataaaattgaacagctaaaacaagtagaagaattaacagatattattgtgtcatcagattctgatattatgcttgaaatggcagaaaaagctggtgttaaagcgttaaagagacctgaaatgtatgcaaatgaatcagtcccatttggtaagtttttggattatctttgtgaagtaatgccaaatgaacacattatgtgggcatgtgtgacttctccattggtagagccatatctttatagaaaagcaattgcaacttattttgaaaaattagaagaaggatatgattccttggtaacgcttcatcctatgcaaagtttttatctggacaaaaatggtccaataaattatgaaacaggtttaaatcataaaaattctgaatttttggagccaatttatcattttacgaatggtattaatttggcaccaaaagctaaaattgcagaatggcattataattacggtccaaatccatataaattaatggtaaataagcgtgaggcagcagatattgatgacatttatgattatgtacaggctcttgctatgcttaatatgccagaagatataaaagatttagaagacgtgaaaaagatagaacgtatattcggggggggcagacctctaagtagaatatctgaacggagggctgcgtgatgaaagtgttaggagttattccagcgcggtactcttcgggaagaatgccaggaaaaccattagctgatatagaaggaaaaccaatgatatggtgggtataccaatctgcggttcaatgtcaattacttagtgaagttgttgttgcgacagatgatgaaaggatttataaaacatgtgaagacctttctatgaatgttataatgacaggaaatcatgatacaccaacttcaagattatatgaggtatctcaaaatatagatgcggatttatatttaatgttaatgggagatgaaccattagttgattataaaagtttttcattaataataccgtcgaatactgagtatttagaatcttattatgttgctgttttaacaaataaattaatgaagccggcagaggtaattgattatagtaatcagaaatgtgtttcgaattccaaaggcgatattttgcttatttcaagaagtcctattccttatccaaagggtagttttgattttgattatgaaaaggttacaggtgtccaaatctttaccaaaacagctttgactttttataacaataccaaaaagtcggagctggaaattgcagaagaaaatgatttgatgagatttgtagagaatggtataaaagttaaggcaattaggtctgattataaaaccatttctgttgacacaccgaaagatcttgaacttgtgagaagaataataaaagagagaaagatttatgacaaaaaatgacttaaaattattagattgtactcttcgagatggtggatatgtcaatgactggaattggggatatcacactgcacgtgcaatcataagattccttacaaaagcgaaagttgattttgtagaggttggctttttgagaaatgtagatgggtataatgaagatgttacagtatgtaataccattgaagaattaaatcgactgttgccggaaaatgtaggaaatacaaagtattcggctatggcgatgagaagtaattatgacattggtaaattatgcccatattcgggtcgtggcatagaaatgattcgtataactgcgcatgattatgatattgaagaaggaatggattttgccagacaggttaaagaaaaaggatataaattaagtattaatcccattaatataatggggtattcggatgaaagaattctttggatattgaaacaggtaaatagtattcaaccatatcagttctcaatcgtagatacatttggaagcatgaagcgaagagacttagacagaatagtcagtttggtagataataatcttgataaaaatataagggttgcattacatctgcatgaaaacatgtcattaagttgttgtctagcacagcaatttgttgacaagcatttaaacagaccggtagcaattgatggaagtttgttgggaatgggaagaataccagggaatttaccaatagagttaatagcagactatctgaatgattatgcagattcggcgtatgatatagactatatgatggatgcaatacaggaatatatagaaccaattaaaggtaaaacggaatggggatatactcctgcatatttcctatcggcaagatttaatttacatagaaactacgcagagtattatttgaaaaaaggagatttgactaatagagatataaaccatattttagccggatttgatagagaaaaagcaacagcttttgatgaagtgtatgcgaatgataagtattatgaatataaaaataatatgatagatgatagttatgatttttcattattaaaagagagatttgccaataaaaaaatattagtgttagctccaggatgctccattaaagaaaaaatacaggaaataagtaaatttatagcaaaagagaaaccaatagtaatttcaattaattttataccagaagattatgaggttgaatatgctttctttagtaatgccagaagatttaatcaggcatcagattttaaatgcaaactgatagtcacttctaatatagagacggataaggaaaaaattcgtcttaattacaatgcactttcaagttcatttgatcaaggatataatagttatgtaatgatattaaaattattgaagaatctaggaatagatgaagtttttgctgccggtgctgatggatatatggataacggaaagaattattataaatcatcactaaaaagtgtatcagtttgcgacggaaattataatttggcagtgagtagagctattcagagaattggaattaatgttaattatctcaccgattcggcatatgtataattaagtttgaggaattatatatggaaagaagaataaaagttttggtcatagatgtagatggaacaatgacagatgcgggaatttattatgacgagaccggaaatgagttgaaaaaattttgtacgaaagatgcagcagctttttttgtggcgagaatagttggtataaagaccatggttttaacggggagagaatgtgccgcaacgacacgaagaatgaaagaaatgaaggttgattatctgtgccaaaatgtaaaggataaggcatcatatcttgaacaaattatgaagcaacagggttggaaaaaggaggatattgggtatattggggatgaccttaatgatttaccttcaatgagattagctgggtttattggttgtccgacagatagttgtaaagaaataaaggaagttgctgattatgttagtcctattaaagggggatatggtgcagttcgggatattattgaacatatattagaagaaagcggagaatggaaggaagccatttcagaagtatatggcgttggtgtgtaaaatgttagatgagttaaaaaaaatagtttgtaaggctaatttgcaattagtttctagcggcgttgtaatttatacatggggaaatgtgtcaggtatttctgaggatcgaaaatatatggttattaaaccatcaggggtagattatgataatatgactgctgaggatatggtggttgtctctgttgatacagggaatacagtagaaggcagatggaaaccatcctctgataccgctacacatttggagttgtatcgcagattttcaatgatgagaggaattgttcacacgcattcagttaatgcagtcgcatttgcacaagccgggagaagtataccggcacttggaacaacgcatgcagattatttttatggggatataccatgtacgcgtgaattaggaaaagaagaagttgaagaggcttacgaggtccatacaggaagggttattattgaaacgattgaaaaatgtggttatgatccaatggctattccgggaattgttgtaaagaatcatggaccatttgcatggggaaaaagttctgaggaggctgtacataatgccgtagttctggaaaaagtcgcagaaatggatttgaaaacattgtttttgaatagtgaaagtaatatgtctcaatatattcttgataaacattatacgagaaaacatggaccaaatgcgtattatgggcaaaaataatgacagatggacagagatatttctatcttagagtacaagatgaaatatatgtaatagagcctcggaataatcaggtgctgtggggcgtaaatcaaaagaattaagagcaaggcagaatgatataagacagaggtaattgtgtatgctgataaggcgaatacgagattgcggtgcagatactataaattcataagacatggaaagaaaagaaatgtggcagtagctgcaatagcaagagaactagcatgttttgcatgggcatgatgacagataatatcgaaataagagcagcgtagagggatattatagccatctgtcagtcaagcagaaaaagcagcaataaactatctgactgaactatctgacagcattagaaaagagctgtggtcactgtatggtctgggttatctgcgtttctagagaggatatcaaaaaaaacagagctttgcagccgttaccagattgctgttttaggtaatgttgtagttgatggtaaataggaaaaaataggatttttaatggcatttacaaaaagagtctaaatgctattatatttataggtgtgtagctttattgacataaaacaaagcctgacgtataataatattttttggggttgaagtttgtatagtatatgtaaatattatatatgatgaattaaaatggatgaatggagtgaatcatatgaatgaaaagaatagggggttcgggaataatgttaaactgttcatttctgacaagaatttaagtgaacagacggtagcagagcatcttggttattccaaatatgatttatggaagattatggatggtcgtctttttttggatgaagatgaaaaacgtgatattgctgaggagttgcagactacagttgaagatctttatatgccaaggtctgaggaaaagtatcatgctgcaggttgtatagagtgtcgaggtgaattcagtcatgctgacactaaagcgtatattttagatttattggatgtatattgcgatgtacaggaattgatagcggagaattaggtcattttttaatggccttttctttttatggagggaaaatggacaagacaatcattggtgctatacaagaatttattaaaggaaaacgggatgaagcaaagtaagcgatgaataacataccgtttcaaatttaattgaagatttgggataatacagtcaataaacagtaagcgactactttatctattttcagatcttgatgcggatgtatcactcttcttttcttaagcaaaggtagccggttactgtgtttaactactttagctgacaggaggagcagcttatgcgtaataagagaagaacagacgaagaatggcagtcatccgtgacaatttccagatggatccgttctccaatgcggtctttctgttctgtggacgcaaaaagaatacgatgaaagccctctattttgaccgggatggatttgtactcctgcagaagcgcctggacaatggaaaattccaatggccgcgcaatgcttcagaagtcagacctctgacaaggcaggaattccgctggctgatggaagatatccacagatgtgggatcatggggcgcgttgtccggggatagttgtgcatgacatcatcatgatgtgcataactttacggaaaatcccggaaaccggctgattttgagagaaaaaaggaactatctggctttcggcataatgccagtctgattttggatggcatttgcaaccatgccttccttttcgtacaataaaggtaacgaaaaaagagggagggattcaccgtggatccaaaaggacaggacatacttttcaacagtgagaccaggcagaaggatcttatgatccagatgctttctgaacggttagatgaaaaagacgggaccatcacagaactgaaggaaaccatcaatgacctgaaagaaacaattgccggtctcagggaaacactggatgaattccagcggaaactctttggtacaggcagtgagaagacaaaacaggataaggaaacggaagaaactgtgacaacgatcgtcaaaagccacaaacggacaacacgcaaagcgaaagcaacgcgtgaagaccagtatggaaatcttccaatccataaggaagtcatccccctgccggaagaagataagtattgtccttattgtaattccaagatggagtatgtgacggaaacgtttgtccgggaagaactccggatcacacctgcgaaatatgttgcaatggaaaagatcggactggcaatgccttattaccggcaggagtttctgatgaaccagctgggatgaagaacttttaaagcatgatctggtgcatgcagacgagacaacatgtcaggttttgcgtgagaagggacgcacggcggagtaaacatcctatatgtggttatatacaaccggcagtgatgcgctcactccaatcgtcctctatgattatcagccaagccgtaaaggatcctgtgcacagaactttatagagggatttcgtggattggtacagtgtgacggataccaaggttacaacaagctggggaaagcggtgaactatgcccaaaaccatcacgacacactgatgaattatctgttggatggcagatgtgagatttcgaacaatcgggcagagcgaaaagccaaaagttatgcgattgggcggaaagctttcctgttccacacatcagagaccggtgccggtgcaagtgcggtgatgtacagcatcgtagagacagcaaaagcaaacaatctgaatattttccaatacctctatacggtattcctgtatatgccggattacacgaattcgtccgcaggtatagagcagctgatgccatggagtgaatttataaaggaacaatgttcaggactaattgatgtggaatctaatgttccggaaaaaagaattcccctgccgcataggtagcagaggaagtgaaagtaaacggtagtcgtttactgctttaactgaatttaggaatatggtaggcggtgtgttattcatcgcttaccattttgtgacgaggaatatcagaatagcgagtgctttatctgtacagctaagacgacttgtgagagtgcgtgtggagaaaactgtaagcaatgcttagatgatattcattttcatcatcataaatacagagatgaatatgactgtgaaaaactacttgactattatgtttgtagatattcatataaatcttgttcggaaattatttatgcattaagccagctgaatctatctcactatccatattttcatattttgtcattgggatgtggaggtgcaccagatttgatggcatttgaatatatgaaatacaaacagggtatatcttatattggtgttgataataatgtgtactggagaaaaatacataactttataaaagaaaattttaagggtggcggagtaaaatttaagagaaacatagatgtattaacgtattttgaaaaaaatgaactgcataagtgtaatgttattattattcagtacttaatctctttcttttttgaaactataggagaagatggaatcagaaagtggttttcatgtcttgcagaaaaaattgttaagaataaaccggataattcacctttattgataatcattaatgatgtggacagtatccatactggacgggatgcatttccgttgtttgtggaagaaatcgaaagagtaggactcaatatttcttatgaatcgagaagaagatttaaagagcaaaattattatgagggatctttgaggtatgaaaataatcaaaatatatttgaaggagaaataccagatagatttattcaggattattgtgtagccaagttttgtgagagtgcgcaattgatactagaggtgatttgatgataattagtgcgagtagacgtacagatattccatcttattattcagaatggatgctaaacagattaaaagaaaaatacgtattggtaagaaatcccatgaatattcatcaggtaagtaaaatagatttatcaccaaatgtggttgatgctatagttttttggacaaaaaatccgactccaatgttggggcgtttagatgaattaaaggattatatatattattttcaatttacattgactgcatatggaccagatgtagaacgaaatttaccgtcgaagaataggattattattccgacatttcaagaattatccaaggagatcggaaaggaaaaagttgtgtggagatatgatcctatcttttttaacgaacaatactcaatgcaatatcattgcaaatattttgaactcttagcatcaaaattagcaggatatacggaaaagtgtactgttagttttatggatttatatcgaaatacagagagaaatgttaagccacttaatattgtgaaagatactcgtgagatgcaaaaggaattattgaaacgatttgtagagatagccagacaatatgatttatatattgatacatgtgcagaactggcagattttcatgaattaggtgttgaacatgcacactgcatcgacagagaaagaattgagcgaattggtggatttaagcttaatgtagataaagacacaaatcaaagagcggaatgtggatgtgtagccagtattgacattggagcttataatacatgcaaaaatggttgcttatattgttatgcaaattatagcgaaaatacagttacaaggaattttggattgcataatcctcagtcaccattattgtttggtaagattgatgaatttgatacaatcaaagagagaaaagtaaaatcattaattgaaacacaactgagtttgtttgatgattagtaaaatgggcggatttatagaatgttagtattttgcatccgcaaaatgatgtcggcatttttaagatttgaaattatcaggtaaaatgaaaacggaaagaaaaagtgtagaaaatggcatttggctataaaataattgcatataaagaaaggcgaggcaatgaatctgtttgaacactattacttaacaaaagacagaatattggatatattgaaaaatgacggtatcattgtctttgatacatcagcacttcttgatttatactattattccgaagactcgagaaacagaatttttaagaatgtgtttccgtattttgaaaacagattgtggcttccagcacaggtatattttgaatttctcaaaaacaaggatacagtggctgcaaaaccagagaaaacgtatatggcattattagacaaggataatcgggacatggggtatgtgccgaagctggtatctacagttacaaaattcgagaaagatacaaaagaactaaaaggaatattaactactttgaaagagacaactatcagagaggacaagcatccatttttagagcaggaaatttttgaacccatagaccgggcagtagatatattgaaagaacaaatggaagctttttcagcaaaagtggaagattttcagattgatataacacagaggattaatgataagattctggatttatcatcgcaaggcgatgaaatacaagatcagatcgacgaaaaatttaaaatcggagaagaacttacttacgaacaaatgacacaaatatcggtagatggaagaagaaggtatgaagaaaaaataccaccaggatacatggatcaggaagataagacaggtctgcaaaagtatggagatttgtttgtctggatggaaattttgaatcatgcatcagagtgtggaaaagatgttattttgattacaaatgatgtgaaagaagattgggttgataaaaaatttgaccgcaaaccgcgattcgaattattaaaagaatttaggagtactacacagaagaatttttggatgtgcaatatgaaagattttttgtatcttgcaaacgaagttattgatgagaagaaccggattccagaaaaggttatggaagatgttgatgaagtttcaaatcagttaccggaagaatcagatgatgatgctgtgatcagagaaatggtaagtgagtggatggatacggaagctgcggttattattgacagacttttgccagtagattctaattggaaagtgttcggaaataacagaatttataatggaattgattatcgtggagaagaatggatagtgctggcacatctggttgaaaaatttgattacgcaagtattttgcatgcattgacaaatttgagggagataaaacgggattatgatcagttggggaaggagtactattattcgcagcttattattttgaaagacaaagcaagtgcagataagtttatgaagaaagtgaagggaaatgcaaagcttagtagtatgttttcgaatgtgtatgtgcaaaatacagtgctgtatatgatgcgtggcagattgttttttgtggatgcgaatcatgcgatggggtaagaaaagaaatattgtcagttcttcagcacctgatataaaagaaatctattcaaaatggagatgaagttttggatggtggaaggtttattgagccagaaattatcggaataataaagaaacgttcaggcatttgcaagggagtaggctattcccttcaaattgatgcatcacctctattgagaaaatatatagctgcggcgatatacaaatataaagaagataatgattttgaagatattttagaaaatatggatattgaagatttttcagatgaaaaaagctatagtcagtatgaaatggtaagacatgttattgttgactgtgctgtaagaaatactaaaattattgacgaatatttaaaaagtagtaaagtgcaaaaaagtaataaagatttgttttttgttgcgttgggaagattaagtactagttttaaagcagcaacattattattaaataatggcttttttgtagaagttgtattcattttacgattaattatagaacaattagcatggggaagttttttattggtagaagaggacgaagagaaaattagaaaaaatcgtacacagagtaatgttgggtatttaaaggaacaattgggcgaaaattatggaatcttatatggctatttatcaagcgaagcacatttggaaccaaaagagatagaaaaatatcttcgaaaggatgaagaagaacagattgcagtgcgtgatcgttcgggaaaagaatgtgaaggtgaaaccaacacattattggtattactagatggatattgtgaattgttatggaaagggatgaatcatttcggtattatggaggaggaaatagaatattatacggattgtcattgtttaaataagaaaattgttatttcaatgaaagcagtattagataataatgcaaagtttgaaaggatttgatataataacagcgcaagggcagttatagaccgtaaaggtttgtagctgccctttttgcgtttatggaacttttggacaaaatgtccagaagtggaaggagagcttatgaagtatttacgtaaaggtcaaaccactcgcctttcacccggtctatttttagtgcatacttgaaaaaaacaatagattttttcaagtgattattccggggctctctgagacacctgtccggacttttggggttcttccgcaattgtccgtcttatccctttagcaatataagcttagcggtcaataactccttgccacaacgtccatacatggtacgttttatcattttcaatttgctgtttgtaccctcaacaaaaccattcgatagagggctggctacagcattttatacggcagataaatctttttccagttgaatattcttggaggaagcccttaaatgaaaaagactaaactgcaaaagaagtttaaaaactgcgttagattacgtcatatcgaatggctttatcgagcatgcgagggtacaattaatttttaagaagtaataatagaacaaggagcaaatatatggtcaaaagttttcatttatcagaacggataacaaataatattctaaaagctgaaaaaagtaattttataagtgaaaataaattgacacatgaatattctagagagggaaaaagttttcaccagtttgtgtcagattgtgtgaatcagggtgtgatttccagaatggatgtagaaaatttcttgttcgaaagtttgttttatggatatcaaagagaggtatatatctatcaagtcgcaagttgtaatgaaaactgtatgaaaccggaaatatttttaaatatattacaggataaatatgaatatatagatgattgtgcatatagcaatatagcaaatatggctgcagatgatgaaaaattagttgctgtaaagacaatttatacaaatgatttacaaagaatagcaaagatacagctgatttttaaaacagaggtttctatattgagaaagggtggtatagtaaaaactttaagttatattccagttgactgggacgttaatagtcaaattttgtctattaaattttcacccaaacggcatgtgtttgataaagaaaaacagccggaacgattaaaaatacattttattgatcaattaaaagagatgtttaacatacaatttattccatttggaaatatacataaagaagcattgtgcgaaatgagtaaatctttatatcgacagatatatgaaaaaatggtttgttcaaaaccgcagaatttagacagctatgttgaagaaatttcagatggattgaagaaggtattaggtgttgaagcattggaattgaaggcaacaggtaataatatatttaatattaaggataatattcagaaatttactgagaatatactgatttcagatattttattaggtgcaaaagaaggtgctacgctagaaggagtagagggagtcgtaacctatttaaaatttagtgatggtaagaaaataagtgcacgactaaagggaagagagtgtagagagcctattttcggttcggaatcctacatggctctaagatctgcaattgaaaatgcacggcgggtgaatagattagaagtcgtctggcttggaaagtttgatcgtttaagaattacttatgaagctgcagagaccgaatgtttaaaggtacatttttataagaatctgaaagaggaagaatataaatatggattacaaatgtttcgaaaatttgaacgatacggaaatggcaaacttattaaagctgttgaaatggaaagccaggcacaatgattgcgacttagactacgtacaaatagctaaatatttaaatgtggataatcgtattgcagaagaatatattcaatatttgcacagaaagcattacataaagaaatggtttgacataaaatgtccatcttgtgggcactacacaagaacggatgaaactgaactgaaaaagggaattaattgttcttatgtggattgtgatcaaacattagatgtacagaatctaaaatataaatatgagattttttataagataaatgatgaaaaagtactggggaaaaaaggtggagaacaaactgttacgcaatttaaaataagggaggataatagttatatggctgaagaaggttctataaaagtatttatgtcatattctcacgaagatgaaaagtataaagaaaagcttgataagcatttggctgtgttaaaaagaaacaaaaagattaaaacatggaatgatagaaaacttgttccaggcaaggatattgataaagaaataggtaagagtttggttgaggcagatataattattttactgttgagtgcagatttttttgcatctgagtattgttattgtacggagatgacgaaagccttggaattatatgaagaaggacagaacatgatagtacctgttattgtaagaagttgtgattggttaggctctccattagcaaaattagttgcgctgccaaaggatggaaaggcgattaataaatgggaagatgaagacgaagcatatatggatgtggtagcaggaataaaaaaagtgattgaagaaataggagaatgatgttggcattttttgagatttgaaattgttaggtaaaatgaaaacggaaagaaaagtgtagaaaatggcatttggctataaaataattgcatataaagaaaggcgaggcaatgaatctattatgcgaattatagcgaaaatacagattgtttaaatcaagagtaggatttaaaacttataaaacaaaatttagaagagaaatcgtatagaggacaggatgacaaaatgataaataatagaaaaaaggtttttatatcatattcatgggtgcccgaggaaaacaaacagtgggttgaaaagttggcaaaaaaattagaaaatgatggaatagaagtggtaatagattacaaaaatttgaagttaggttatgacaagtatacgtttatggaaaaaatggtgaatgattcttcaattgataaggtattaattatttgtaatagtgaatataaaaagaaagcagatgcgcgcataggtggtgtaggagatgaagccacaataataacaccacaagtatatagacaagcagagcaggaaaaatttattccagtagtatgcgaaaaagatgcaaatggagaaccttatcttccaacatatttagcatctcgaatgtatgctgatttgacgaatttttcagaaggctataagaatttgttggaaaatttaactggcaattcagagtcacaaacaaattttggaacagcttacataaacaaaaatgaagtaaaaaataatgaaaaatgcattgaagaatatgtaaatatatgtatagagattataaaagagccacgtattatatttagtaaatcatttgttgataaattaattgaaaagcaaattgctttatacaaattgaataatcaggttttaattaaattgacaggtgagttttgtaaagggatacagaataggttgaatgcatttgatgaggaatctgctaaatcgttatggaatatttcagatagaatgcatgaaattatggaagaaggtcttgttgaatgtggagaaattattgaccaagttgaatttgaaacacaggagcatataaggaacgaggtgattgcgtatcaattgggaaatatagttgatgacaatatggttagagaacatattgatgatatatatacatgtataaatggagagttgacatccacttcagagctatctaatagatatgtgaaagcaaaagaacttgataaaaaagttgttctaaatctggaaaagcaaaagacaaatgtatctgaatctaatggggtgcaggatttaagactctttttcaaaaatgtaacagataatcaggcaacaagtataaatattatgccaagtgaaaatcttgtaaaagggatggaaggcactgtgtggggaaaaaatcaagaatcaaaagcaggtgtaattattacaaagtatgaagcgatgataggtgatattaatgttgacgaaaatggagaatttcaatatatgttaagatataaaacatataataatcacttctttttggtttgtttctgcgttgagatccggagtatatatggaattaaaacagaacaactatttaatattgttataattaatgggacaattaatcaagtttttattgaaacagaatactaaaaagttaattagtattatgtttgggaatcaagtgggaaagtaaaattggcgttagaattatgaaaataataattgaatttactcttgaataatggcataattctatataagggacaaactttagaagataattattttaacaaaataattagtgctctagcctgggcagagccggttactgtgatgggaaagattggaaaagatctccaaatcaatttgcacaaattgatttgaatctcttttccaaaagtactttaagtaaagttttattggagcagatgagatgatttcatacacagaagaaaatatacagagaatattacaaaacctgaaagaaaatattcgtgagaaaaaattctcatcctccaagttccctttatttgtttttatctgtggtgagcagatattagatgaaaatagccagattatggcagcagaagatttgagaagtaaaaaaaataagcgacaatatattttggatgctattgatgaaataaaaaatagaaaagttgttggtgtaattgcataaaagcttattgagacatttagtgaacatgacagtttgacatttgagggaattttagcagatataagtgatgagataattataatagtagagagtgtgggcaccttttgtgaattaggtgcattttctttttctaaggatttggtagataaattgtatattattaatgatgagcagcacagggaggataaatcatttattaacaggggacctattcgaaaaataaatgattcacgtagtggtgaaactaagtatattatatatgatacggacgaatggaagcaggatttggaattaaaaaatcactttgaaaaatgggaaaagaagaggattagttatacaccgcctgagaaaattacaattaacacaaaagaaaaatgtcaggttgatattaaaaattttgtatacgaagtgattaatattttaagtatttttcaaccaatcacacaaaaagaatttttgcttatatataaattcatgcggggagagttctctgtaaaagattctcagaataaggtaaaacagattagcacaatatttgatatgatggtgagactggaattgattacaaaagagagtgaattttatactaccaatatggggacatgctgtaataattatatgtttgatctgacaattaatgaaaccgaagagcaacgcgcaaaaatattaaaagaatataataaatatgatcccgcacgatgtggaggaagcaatgtatgacaattttagaaaaaatgtccagggatttaggattaagtgaaaaatacatattgtcaaaaataaacagatcgtacattttttattcaaaacatttcacttataataaaagaggaaagaaacgtgaagtatatgaaccgagtgcagagttaaaattatttcagacatgggtaaataagaatattttagtgcattatcccgttagtatatacgctacagcatatgaggatgaaacgtcaattcgaaaaaatgcatataggcataaagattccagttatattttacatacagatatcaggcatttttttgagtcgattacatttaaacaggtatcggaaatttttagaaatgattattcggaagaagatatacagacaattttaaaaattgtgatgttaaatggaaaagttccaaccggaagtattactgcaccaagaattgcaaaccgagtaatgtatgattttgatgaagaattagtggatgaattatcaaaaatacaaaaagtaatttatacacgatatgctgatgatattgttatttcgtctgaagaatatattagagaagacattcttcaaaaaataatcgaattattaaaaaaatatgggtttgaatgtaataaggataaaacttattatgcaaataaacggtgcagaaggaatataacgggggtagtacttgataataatcatgattccatttcaattggctggcggagatataaagatttaaagttgaaaatatataaatatctaaaatatggggatggaaataaagaaagcataagaggtgaattagcttttttaaagggaattaatggtaacaaatatcttgctattaagaaccattataaagatatggacttaaatggagatatattttaagtaaagcatttgtatagttgactggtagaaggcaatttggcacactcagtacgtcgcataataataattatacgacgtacttttacatttacagttagcaaaattactgttattctttatttagaaaaaataggaggagcggtagagatgaaattgttgcgtattccagttggggtgtctgattttgcggaaatccgcaggaatggttattattatgttgataaatcaggtctgataggcgaacttctcggtacaacaggaacaaaagtaaccttgatcactcgccccagacggttcggaaaaacgcttggcatgagcatgctggaaagcttttttgatatccaaaaggacaacaagacactgtttgagggacttgagattgcaaataggcatgatctgtgcacggaatggatgaatcagtggccgactgtgtttgtttcgttccggcaggttgatggtctgaattttaacagtgcatacggtatgcttacacttgtcatctcggagttgtataagaagcacctatatctgttagatagcgataaggtagatggttatgataaagaaatcgtaaaacaactgatacagggtacggcttcggccaaggatacgaaaggaagcctgatgctgcttacgagactgatgtgtcagcaatacggcaaacctgtgattctcctgattgacgaatatgatgttcctgtggcaaaggcaaacagcaatggctactatgaggagatgttagatgtcatgaagggtctgatgcaggctttgaaggacaatcaggcactctgctttgcagtgattactggctgcctgaaaattgcgaaggaaagcatttttaccggaacaaataattttatttcagacacgcttacggattccatactgaatgagtattttggctttgttcaaagtgaggtagaccagattcttaaagatgcggacgttttggataaagcagaaagcatcagggagtggtatgacggataccacttcggtgattttgatgtttactgtccgtgggacgtgatgaattatctgctggagttacagcgcaatcctaaagcaaaacctgtcagctattggaagaacacgagtgataatgcagtcatccgctcgttcattgattatgctggaagcaacatcactgggaaactggaaactttgctggcaggaggtacgattgttcagcgcgtggatgagaacttgacttatgattatctgcattcttcagaggagaatctttggagtatgctgtatcttaccggctatctgacaaaagcacgcgaagaagattataatggtaagctggcggatggtacagtagcgtttatgatcccaaacgctgaaatcaaggaaatctttgaaacgactgttgtcaaatggttcgatgacagcacgaaaaaatgtgacaggagtacgctgtttcatgccgtgtggaatggtgacagcgagaaccttaccaaagagatgaatgtgttgttgcgaaggactatcagctaccatgattataaagaggacttttatcatgcgtttcttgcaggtatttttacaggggcaggatatatggtagattctaacaaagaacatggagaaggtcgcagtgatgtggttgtgtatgatcccatcaatagccgggtggcagttttcgaagcgaagtatacgaagtctctggacaaactggaaagtgagtgcgatgctgccttgcagcagattgatgacaggatgtatgcaaaagagtatgaggatgattatgaccaaattctctgctatggcatttcgttttttaagaaacgttgtatggtgaagaaaaagctggcgaaaacttgaacaacgtaagtttactacagagcagtccatggaacttgcaattgcagcagtcaagattgcatgtgtgaagaacggtctggatcacgtctgcctgatgtgatgtaacttgaaataaaagcgggagcagacgctgtatgtgagaacatcagacaggcattgcagaaagaacagattgcagtgacagttcttgataacgtattatatgatgctgaggctatggagaaactagaacaggagaaaggtggcagattaagggcttccgaggaggaaacccttaaataataaataatcgaactacaaaagaagaataaatataatataaattacgtcatatcgaatggcatttaatgaaaaatagtatacaataaatttgaaaatattgtcacagcaaggaaacagcatgaaaaaagcacatttgaaatgataatggaagtagtttcaatatacagttctatagcagctttaggtgtatcgtgtgttgctcttatggtgtcagcagataaaaaatctgctgaacatgttggaataatagtatttatggagtgtaagacagaagattcgagatagcgtatttaaaatggaatagtcataaaaaagttgaaggcaaatgagggaaaagaaaataagtgaaaacttaatagagttgattttaaatagccagtccgatacaaggagtggctattaaacgttttgaataaaaaacaaattgttggtagaatgtgataaaatttaagttgtacagcttatgtcagatgagaacaaaatcagctgcaagaaaggaatatatagtttttatgaataacgatacattattatattggcataaattagagaatttttatccttatatactggaagaacagcacaacgagaaaataaaatcatttaagatagcacgggaatgtgactatccagacttggaaaatccaacaattcaggaaaataattgtgtacggtattatgaagtgtatttgggaatttttagggtgaaaagtgcattagatgtgattgctaaacagatgaatgcagaaaaagagttccgagatgacagtaatgaaacaagttgtttttgtaagtttagattaaaggcagatggaaaatttgatgaaacaagttttagaatatcgtcatttccatgggcaattaacagggtaaaacaaaaacagatagaacttaatcagtgggatgatgattttcatgaatatgaaacaagattatttatgcaattgtttgcatgggatgaagtggtggactatgaaaaatgcaggcagatagtaaataggataaagagtgaattatcctggaatatagaattttcagggtgctggatgcgaatagacagggttgttggtgagaaaaaagataatcagtctcaagaacatacagcggtggttgaagaggaagaccgccaaattgatgaactgatcaaagcaaatgatttattgaatagtttttatgtgagagatctggaaaatgtaattaataacgtatcgaaacaaaattatggtcaggcattggaacaatatttgaatcataattcggataagcgcatagatgtagaacatgataaggacgctctttttgcaatatttgatccgaaaacaatgccatatggtaaatggccaagtggctattcactaagaagcatgcagcagctagctgtaaatattgcgatgaaccaaaaggaagggtatacgccggtgttttcagttaatggacctccgggaacaggaaaaacgacattgctaagagacgttgttgcagctaatgtagtggagagggcaatagctctgtgtgaatatgagaagccggatgatgtttttgttaaggaaataggtataatttcttataacagatataacaacacgataaaagagattgatgataaattaaaaaaatatactatgctggtagtgacaaataataatgcagcagcaaaaaatattacgatggaacttccagatatcaaaagtatttcgaaagagtatcaggataagtacacatattttaatcagatttcagaccaggtattaaaacgaaaaacatggggaatgtgtgctgcagcgttaggaaatcgaaaaaattgttcagcgtttattgatgtattttggcctttaaagaaagaagaagatgaattctttgattttaatcgttatttgaggactatccagacacagaaaacagcaatgcaatataaggagaactggaaagctgcaaaagatagatttagtagcgtgttaaaagaggtgcaaactgaatattcgaaaatggatgaatgttattgtacattaaagaaaataagaagaatgcagagaaatatttcagaaaaagaaagaaaactcagggcagtacgaaaacgtctaagcaaattatatatggaaaaaggggaagctgaaaaaagtgtacaggaattagaaatgcagagattacaaatgcaaaaacaaaaagatgaaataagacaacaggtattattttttaaaattaggtattggatttgtcctaaaaatgagatgatagtggcatataaaaatattgaaaaaaaagagaataaatgtctgcatgaaaagtttgaaaaacaggaaaaaatacgtatcttaataaaactgattaaggagaaagaggatacagaaaagcagtatgggaaagaaattgaagaacagaaacaaaaaatagaactacaaaaccaacagattgataatttcaaaaaggaatatgatgaatatgttccagacgatgattatctgatgaaattgactgaatcagaaaaagcacaggaatataaaacagctcaggaaaaagcaccgtggaatggaaaagaaataaataaattacgggaaactctatttttagaagctatgaatttgcagcgagccttcgtagaaaactcatcacagatgagagatcaattggatgcatttagcaagatgatgagaggaaatttgagcagtacccagctggataaatatgcggcttcgttatttcagggatttgcattagctgttccggtaatttcaagcacatttgcatcaataggtagttttttacgatatgtaggaagggaagatattggacttgtacttgcagacgagtctggacaagcaatgccacaagcagcagcaggtgtgatatggagatgcaggagagtgattgcagttggtgatccattgcaaattgaaccggtagttacaatacatgataagacaattgaatttttgaaaaattattataagcaatcggcgtttattgcaagtaaaacaacaagtgtacaaagtcttgcagatgcagctaacaactatataggaatccgggaattagatggaactaatttttatgtgggatcaccattgctggtacatggaagatgccagaaaagaatatttgacattgcgaatattatcgcgtataacgagacgatgatatataatacagtcgatcgagaagagtctgtatgtgcgtggattgatgttaaagggcagtcacagaataaacattttgtattggagcaggcgaaacgtattttgccaataataaagaacgagtttattgccagctggaataagaatggcaagtcagaaattccttccttatttattatcagcccgtttagaaatgtgaaagcaggactggctagctattatagggataacgatttcttgtatcataatatttgtgaaagcaacgatgttgaatgcaaacaaaatataaaagattggataagagataatattggcacaattcatacatttcagggaaaggaagcagatactgtaatcatatgtcttggagtggattctggagaaaaagaaaatggagcagtagaatgggcatgcggcagaccaaatatacttaatgtggcagtgactagagcaaaaaacaatctgtatattgttggagatgctgataaatgggcttcaaagccgtacttttcaactgcgtatgagttgtgtgagaaatgtactgatataaaaataagtgtttcttaagcatttttttgatataaaaattgtaatttgcataagctggtatggcagattggcagtgtggcggttaaactcaaatttaaattgatatcacaagataaaattgatgctttgcacagacatggttctatgctataatagcgcataatggcaaaatcaaaggatgagaggattatcatgaacgaggaagaagtacagattgatttaatgacattgctgcactatatattacgtaagtggcgtagcattattgttgtgatgctgattgtggcagttgctgcgaatctatattcggtaaaaaaaagtatgtcagtagtggcatctgtaagcgcagctgaagaagaagtggatatagaaaagcagattgaaaatgcaaaagaggaattgacagcggatgagctggaacaggtagaacgtgtatattccatgtatgagtataattcgcaattatatcaggaaaatgacgaatatcttgaaaagtcgatgttgatgcagctgaatccaaatgagattccgactgtgatgctgaactatcagtttaggaaagaccaggcagatgaagaactttctaatatctttacgatgtatgagaatgcattattagatgaagatacttgtacagcaatcatacaggtatttggagaagaatatgcgaatacgtcagtcagggaattgatatcagttacagacacagagaatgtacagaatagtgatattataaagcttcagaatgataaaaactctggtattctgagtattcagatttatgcagatagcgaggaacagtgtgagcaggttgcagaaattgtgaagaagagggtaatggaatatacagagcaattgcagcagatatttggaatttatacagtaaatgctatttcggagcagtattatatatccagtgacagcaatctcaatatgcagaagtcagatgtggtcaatgcagtaaatgacgcatatactgcattgaaaaatatttcttcagggctttcggagaagcagatgacatattacaatctgcttgtaaaaggtattgaagataagaccacgtcaaaagaaaatacagatgaaacggcggaaataacagctaatgtacagtacattagcatgaagtatattttgatcggacttcttgcaggtatgttccttgcagtatgttggtatgcagttgtttacattatgacacagacagtgaaagatgtagatgaagtgaagataattacgaatcttccggtatttggaactgtgcttggaagcaatgagaatggaaagcgtaatattattgatcgatggattgattcctggtttgcgcatgataagaagagtgagaataatgaacttttattaacacgtatcagtcatgaagtagcaatgcttgcaggacagaaggacaagcgaaatcttttggttgcgtgttcagaaagtgaccagaatttgaagaaacaggcagatagtcttgtggagaaattaagagaacttggaatgaatgtaaccagtacagatagtctggtctctgataatacggaagtactgaaacaattagagagtgcagatagtgcagtctttgtagagcagttgatgaaatctgaaagaaatcagatcagggaggctgtagaactttgccggcgctgtcaggttgaggtgcttggaagtgtaattgtcggaagcgattcctattagaattggaatagttggtttaaaaatgatattagtaaaaaaatatgcttttatcgtggaatgtttttagtgagtgcggttatcaatgattaatgaattgttgataccgcattttcgtctacatattgcacaaatcagaaatccctgcctttcgcaggctgtatcgctttcggctggtcaatggaaagtccttccatcagccagcggaattcctgccttgtcagaggtctgacttctgaagcattgcgcggccattggaattttccattgtccaggcgcttctgcaggagtacaaatccatcccggtcaaaatagagggctttcatcgtattctttttgcgtccacagaacagaaagaccgctttggagaacggatccatctggaaattgtcacggatgactgccattcttcgtctgttcttctcttattacgcataagctgctcctcctgtcagctaaagtagttaaacacagtaaccggctacctttgcttaagaaaagaagagtgatacgcccacatcaagatctgaaaatagataaagtagtcgtttactgtttattgactgtattatcccaaatcttcaattaaatttgaaacggtatgttattcatcgcttacgaaacatatccttgccaaaataccggttttgagatagaattgagttgttttgtgagaaacttttagaaatatgaggaatagatatgaagaagttatttcatcagatgatgaaattcggtctggtaggtgttatttgctttgtaattgattatatcacgggactgattgttttaaacgtgcttatggcactgtttacggatgcgtggtttgaaaaagcctcaatgataggatcagcagccggttttattgtttctgttattgttaattatatccttagttttaaatttgtttttgaaagaaaacaggaattgaacaggagaacagagtttatagtttttgtgatactgtcagtgatcggacttatgattaatagttttatgatctggatcgcagtaggaccgatttataggaatagcaaattccttcaggaaaatgtaggatataatctgctttataccggagcaaaaataatagctacagcggtggtaatggtttacaattttgtgaccagaaagattttcctggaaaagagatagattgagagggggagagaatggacaatatagcagttttaattccatgttataatgaagcacagacgataagaaaagtagtaacagactggaagaaggaacttccggaggcagtaatctatgtgtatgataacaattcgacagacaatacagcggtgatagcagaagaagcaggagcaattgtaagacatgagtatatgcagggaaaaggcaatgtaatccgaagaatgtttcgggagatagatgcaaaagcatatattatggtggatggtgatgatacatatccggcggaatatggaagaaaaatggtaaattgtgtacttcagaagaatgcggacatggttgtaggggatcgtctgtcctctacatatttccaggagaataaaaggccatttcataattttggaaattctattgtgagagcttccattaattttttatttcacacagaaataaaggacattatgacagggtacagagcgttcagtttccagtttgccaaatctttcccggtactttcaagaggatttgaaatagaaacagagatgagcatccatgcagtagataagaatatgcaggttgaaaatgttgtgattgaatacagagatcgaccagcaggaagtgagtcgaagttaaatacttattcggatggaatgaaggtgcttaaaacgattatgcggctgtttagaacttacaagccattagcttattttggcacaattgcagcagtattggcactgctctctgttatttttgtgattccggttttttcagtctatttaaagactgctttggtgccaaacttcccaacattgatcgtttgtggctttacaatgctggcagcaatcctttcactttttacaggattgcagttacagaatagtgtacagaaaaacagacaggactttgaaatgcagctgatcagacttgatcatgtcagaaaggatttggaggcagactatgaaaaataaatttataaaagaatgtgtgtggataatagtaatattaattgtatccatattaacagggactgttttaatgattgcatcctatgcattgccgactgagccaatgaagatgcatgcaagagaaacaatatcgatgatggcagatgagggagatgattataaatggattcttaaagattttacaagtatggctgctaattttactgattcactgatgatcaatactgctgtctatgatggtaaggaaagtttgttggaaaaagcactgttaaatccgagaacgaattatgcagaaggcacgcagaccagaaaactgataaatgcattacaggatgttccgggcggagatgcgtttacatatggtagatattggcatggatatctggtgattctaaaaccgttattatttatttttaattattatcagatacgatggctcaatacgataataggatgctcactcatatcgattatcatgataggattttataaaaaatttggaagctgtaaatatgcactggcctttgctgcaagtgtgctgtttcttaatcctgttgtaatgagaggatctttgcagtataataccgttttttatgtgattatgatagagtatatctttgctttgtataagggagattccttagaaaaaaagggaagatatgatcttatatttttaatgagtggtatattagtagcattttttgatctgcttacgtatccgattgcagcactcggcatgctgcttgtactacaattactgatgtttgaaagtaattttatcaaagatgtcatcagagcagcccggtcttctattgtatggattattggatatcttggaatgtggtgtggaaaatgggtggtagcatcattattgacagacgaaaatattattgcagatgcaattggcgaggtgttatttagaactggaacagatacaggcacagaagaatggattttctcatggcgagaattatttagaggtaatttcatatggatatatggtgaaaatgcagttttgtttaaaatgtttgtaattatgctggttgcaggtgtaatagcattgttgatcggaaagaacttacagattcattttaaaatgtcaaccgtggtaattttattacttttctgtatgattccggttgcaagatttatagttttcagtaatcattcatttatgcatagtgtattcacatatcgtgaaggaatggtatatgtgatggcagcattgtgtgctggtttttcgggtttaaaattaaaagagaaacgagaataactaataaaaattgatagaatacatttgaataataaaaaatattatatttaaatagtgtctgctgaacaaattgaaaacacttgattttactgacttttaccccattttctgctataataattgcaaggattttgatgaattcaaatccgcaaacgcatttcagcagagatgctgattgaagcaatcgaacgtttcaaagcacgtaccggcagaccagtttttcactttatatgcaaagaaaatggtttgcggttcataatgtaataaccaagcaaaagtgaaaaataggaatatacagggtaaatatgtgctgtttctgaacaaccataaattaaaaagaagaacaaaagtaacaacatagaggtattgtgtttgattgctgccattataatcgcatatataattgcaaaggtgaggatgattgtggcagcagttccccagtgaagtgaaacgtatggaaagaacatatccagacaatcattgtcataaattggaaatccataaaaaccaaaaccagaatttttactatagaaagagcacgataattggattctggaaagcattgtgccattataagacgcaaaatattcaggatggtggaggtataaataacagccaatcaaaggtattccaagacacaggagaaatgctccagatgtaaataataccattaatttgtggaaaatagcatcgtttaccataattgataaaagatgtatgataattaacattaaaataattacctctgccgttctgctatttgcagttttttcaagaagtagaatgaatccaatataaagaatgatatcataccattttttcttttcttttcgaagatacataatatccatagcgagaagtaaaaaatctaatcccatcatgttaggatgagtccatccaaagaaagtacgtgttcttccaccaatccagatgttgatctcatttatcatcagtcccataaatggtaaagtaaaaaacagaatacatcttacaatgcgaatatacaaatctaattttacgatttttcgaatttctatatttttggcacaaaacagtaacatcatggttccgaaaatattatagaaatcaaaattatattgatagcttttgcagcagagatagaataggagcatcaggaaaatccaatcgagaatagaatttttttgtaaaatattttttattagcagcataaaaagcagaatatgataaaatacaacaagttgtcccatataagctggaaatgtctttctcataaaactaaaaagaggatagtaaagacctaataaaaaataaacaggatagagtaatgcactggaaaatttatctcgcttctgcagcgtttcaattaataagttcatgaattgtctcctcaataaatgtttgatgaggagaattatagcataagattaccgttaagaaaagaaaaaggatagaaattcgatggtatagttcttgcgattgggatttatagtgagtataatatatacagtttgtattttgatggaggcagaatgggaaaattaatcagtatagttattccatgttacaatgaggaaaagacgataaatattatatgtgaagctatacaaaaaactatggaacaagtggatgatatggagtatgaactattacttgttaatgatggctcatcagatgatacattagaaaaaatgcagaaactggcagaaaaaaatacaaggataaagtattattctttttcaaggaattttggcaaagaagcggcaatttatgcaggattatgtaatgcaaagggtgactatgttgttacaatggatgctgatatgcaggatccaccagaattgctgccaaagatgttagaaatactggagacggaaccatacgacagcgttgcaacaagaagagtgtcaagaacaggagaaccgctagtgagatctgcatttgcccgtattttttataaactgatcaatcgaatttcagatgcagaaattgtagatggggcaagagattatcgtttgatgacaagggcgatggtacaaagtgtactatcgttgtcagaatacaatagattctcaaaaggaatatttgcatgggtagggtatcgcacaaagtggattgagtatgaaaatgttaaaagagttgatggagagaccaaatggagtttctggaagctgctgaaatattcgatagatggtatcgtgaatttttcaaatgttccattgatgatatcatcatatcttgggattgttatgacgttcgtatctttccttgcaattgtatttattatagtccgaaagatgatttttggggatcccgtaagtggatggccgtctttggcatgcattattacttttgtaggtgggattcagttgttttgcatgggaattatggggcaatatttgtcaaaaacttatatggaagtaaaaaagagaccacattatgtaatctgttgcaccaatgatgatgaggcacagaagaataagtgagtagaaagaggaaagaaaatgaaaaaaaaattagttacattcgggataagctattgtattgtgtttttaaatgtatttatgacaattatttttggacctgctgaaatttttatgggaaattataaagattttggagtgatttacagtgagtttggatggacatttttgattggcggaatcattggctcaattgtaatagctgccattatcgctttgttcccagaagtgcttagaataataattttaagtatagggtttggtgttggagtagcgtgttatattcaggggatgtttttaaataaagggttggacatgcttggagctaccgctgagggatatcatgcaggaaagactgagatgattcagaatggcgtaatctggatgatgattattgttatagcattggcattgtcatttgtattgaaaaagtatcgtgttaaaatagcagtatttggttctctgttcttaattgcgattcaaatgagtggatatatttctttgttttttacagcagacaaggaagcatttcaatacgcggaaggggaactgtgtctgtcaggagaagaacagtttactgtatcatccaatgagaacatcatagtttttattttagataatttttcgtcagaatggcttgcagaagcaaagcaggagattccaggattgacggatggattggtagactttacttattataataatgctgattgtaattcgtatagtacatatccgtcattggtaagactggttacaggacatgaacttaatccaacagtaagtgtggatgactatattacggaatgttggaataacgaaaagacagatgattattacaatctgttacatgaacatggctacaaagttaatgtttatacaccggaactgccaattatatgtggatcaaagacattgtcacttgcaacaggaaaattggacaatatcgcgcaggaaagtgactcaatacaggtaaatcataagcttctgtataagactttgattaagatgtcagcttacagatatgcaccaaaatgtttgaaatcaagatttaatgttggaatgaatgaatattcagaaattgtttcctatgcggacaatgtgattgcaacgtcaaatccaaatttttataatacattagtcgaaaatggtcttaaagtagatgacagcagtaactattatcaatttattcatttgaatggtacacatgaatttattaatgatgaaaattgtcagtacgcagatggagcgtcacggacgcagacgattcaagggatatttctgatgctgaatgaatatttaaatcagctgaaagcggcaaatgcttatgataactcgacgattattatcacgacagatcatggagtagccagaaatatgcagccaattttctttataaaagaaaaaggacaaaaacatgacagtgtgcaggagagtaatgcgccgatttcgttgaatgaatttgttccaacaatcgtaaatgcattaggagaggatcatagtgaatttggattctctatttatgatttctcagaaaatgaagtcagggaaagaactgtatacgagagatctcaggatgatgcatatccggcagtgaaaagatacgatggaggaaatgcgggacagaatgtttatcatgtgtatacttatagaggcaatctatatgacttccagtatgtatatgataatggaatatatgatgtaattccgatggtggattcgtatttttaaatgaaaggagatagagatgaaaaagaccaaagatagaatagtttcaataatagcactattagttacagtactgtatccttgtttgtttatgtattttcaaaatgtggatgagggaaattttaaagagattttaccggcagtcggaaagtttttattggttactggaattgtatttatcctggtgctggcaattataaaaagattttcaaaggcggctttgtatacaatattgtcaatgattgcttttatgaattttaatacagttttaaacgcacttagaaaaataattcctaaaatgcgtacaatttattttctggttgttctgggttgtttttttgcggtacttttatatatttttataaaaagagttgcagatggaatgattgcattaaaaataattggacttgtgtttacaattttaattgtaataaattttgtgtctgctattccagctatcacaaatagatatttttcggaaaaaacagttggtagtgatgatgctataacagcatttaaatttgaggacacgaagccaaacgtatattattttatttatgatgagtatgggggatatgaaaatctgcaaagatattatgattatgataacggatctttctatgatgatttaaaggctgcaggagtgaacgtttcatattctagtagaaacacagagtcgatatttacatcaacgattgtaccgaatcttatgaatttatcttatgtagcaagtgatgatggatattcgattgataatattgcattaactgaaaatgcatcattactaaaattgtttcaaaataatggatatacagttaacatgattgatcatttgggctttttaaaaacagcaggttgcaatgtcttgaatgatgatttggagggggatacgatttcaacttatcttattaataacagtgctttaaaacaaattgagtcggtaatgaaagaactgtataagagaagtcatggagatagtatgtcttatgaaagttatactagaaatatattagaacttatggaaaattctcctgattatatagcaaagaatcagccaacattaacgattggctatatacagtcgcctcatgatccaattatgtttcgagaagatggatcagcgttgccggaaaatcaatggcataactggaaggacaagcagttatatataggacagttaaaatatataagtcaaactatcgaaaatgtaatacaaaatataaaagaatcagatccagatgcgttagtcattatacaatccgatcatggatccaggtatccgtattggatggtggaagattttgatgcagaagcgtatgatgaacaagaagaaaatttttatatgcagaatattttgaattgcgtttattataaaggagaaacgatagacatagaaggagaaaatggaataaacacacttagaagaaccttgaattatgtttttggaacagattatgaaatgttagactcggaagagtgtgtgaaaacatatttataattggattatgcggagtgatttgcatgagtacataagaggagaggaagatgttatttaattcatatggttttatagtgtttttcccaattgttgttattgtttattttttgttgccgaaaagaataagttatttatggcttttggcggcaagctactatttttacatggggtggaatgcaaagtacgcacttttgcttttggcttcaacaataattacatatgtatgtggcgttttgattcaatggctgaatgacaggcatccggataaaataagtactaaaaagtgggtggtggcgggaagttttatattgaatcttgcaatactgttcttttttaaatacttcaattttacaattgaaagcattaatgctgtgttaagtcatacaagcttaccggcagtaaacacatctttggatgttttgcttccggttggaatttctttttatacttttcaggcacttggatataccgtggacgtataccggggcgagatcgaggcagaacgcaatttcttccggtatgcattgtttgtgtcgttttttccacagcttgtagcagggccaatagaacggtcaaagaatttactgacacagttgcgtaatccgaaaccattcagctatgagagaatgtgcgatggggtaatgttgatgatctggggatactttttaaaacttgtcatagcagaccgtatttctatttttgtggataatgcgtatgccaatgtcggggtgtacgatggaaagtatcttttgattgccagtatgctttttgcaattcagatttattgtgattttgctggatattccacaattgcaattggagcagcagaggtaatgggattccagttaatggataattttaattgcccatatttatcacagtctgtcgcagagttttggagaagatggcatatttcactttcttcctggtttaaggactatctttatattccgttgggtggaaatcggaaaggaaaagttagaaaatatattaatattatgattgtatttctggtaagtggactttggcatggagcaaattggtcttatgttatctggggtgggttgaatggaatttatcaggtgataggggcagtttttacacctttcagaaataaaatcagggaaaaattacatctaaaaaagaatttctttccgttgatgatcatttatatagtggtaacctttgtattggtagattttacatggattttctttcgcgcggatacagtgcagcatgcatttgcggtgatccaaagtatttttaatatgaataatccggcattgttgtcgaatggggcactttatgatatgggactgagcagaccgaattttatagttcttggtgtttcactattgatattattaacagcagatatatttaaatatcgtgggattaagattcggagcatgattttaaattctaatatcgttgtaagatggatcgttgttattactggaattcttggcattttagtgtttggaatctggggaagtggatattctgcgactaattttatttattttcagttttaaagctgtagtagtattagaaggaacaaagcgtctggaagaggaaaaatgaaaactattaataattttattaaaatcattatttttctggtggttttgaatggtggaatacttttgataacatatgtacttacacctaaaataccatcattttacagggaaaagcattatgatgctgttttttttggaacaagccagtcatattgttcttttgatcctttgatttttgatgaatatgatttgaaaacatataatcgtggcagacagcagcagacgatgaattatacttattattatatcaaagatgcattggatgtatgcgatattgatgttgtagttcttgaaatttttgggatgtgttatgaggaagatgatacggggtttataagtgaaggtgtaagagattcgtcactgaatgatatgagaatgtcggaaactaagatagaggcaatcagagagtgtgttccagaagaaatgcaaataagttatttttttccattggataaatatcactccagatgggaggaattagattatgcttcctggaatggattttataacagtgcattaaagccatattatgaggaagcagatcggggatataagcgttggacagaatcggaagtatgtgtggatgattattggagtattgctttttcagaaattcgaagagatgtgtatgcagagaatatcaagtatttagataaaatctatgaactgtgtcagaaaaaaggagcaaaattgatattagttaaagcaccattgccatgttatgacagagtgattgaagaaacgaatactgtttcagactgggcggaagaacatgatatagaattaatcaattatatgagattacaggatgttcttgaattgaatttttatacagacagtctggatggcggaactcatctgaatgaaagtggtgctggaaaggtatcaaagcatcttgcagcatatttaaaagaaaattattttgaatgatagtttgatttaggactaaagtgaaagaatagtttgtggggatacaaatgaaaaaattaattagtttgatgaaagtacttattttttgtggaattttggctggaagtatttgtggaattacgatagcattgcttccaagaataccggacttttacaaggaagaacattgggatgcagtgttttttggaacgagtcagagctattgcacctttgacccggaaatatttgatgagtatggtttgaaaacgtataatcgtggcaggcagcagcagacaatgaattatacatattattatgtcaaggatgcgttggataacagcgatattgatgttgttgtgttagagatatttggtatgttttatgatgaggatgacacaggatttacgagcgagggcgtgagagattcttcattaaatgatctgcgatattctgacataaaagtggatgcaataaaagattgcgtgccggaagatttgcagttggattatttattccctttaggtaaatatcattccagatgggaggaattggattattcgtcttttgagggctggaaagagagtgtaatgaatccgtattttacagaagaagggagaggattcaaacattgggcaggcgcacagccttgtgggtatgcatcctgggatactattttttcggagcagagaagagaagtatatgagaaaaactttgaatatctggataaaatttatgaattatgcaaagagaagggagcagaactggttctggtgaaggccccatttccatgctacgacaggacagttgagatgacaaatacagtaatggattgggcagatgaaaatgatgtggaattgatcaattgcatgaaggtgacagatgtgatcggattgaatttcgaggaagacagcctggatgcagggacacatctgaatgaaagtggtggcagaaaagtatcacagtatattgcggagtatttaaaagaaaatgtattgaaataaaattcaattatagaaaaatgatacactagatggatatttatgcaagctggagaattagataaattactgaaaagtgttctgattatatatgtaacattgacaacaatgaatgctagtactatacttcaacaagatttatgtatttaggagaaaaagtatgatcacaaaaagagaatttgatacgttggtacttctgacagagacaaaagaggttgtatctcagaaagatatggcagagcggttaaaaatttcagctgaagccgtgaataagacagtcaaagaattaacagaaaaaaactattgcgaaaatggacggatcacacaggctggtctggatgcattggaaccttatcgtgtgaagagagcagtatttgttgcagcaggctttggaagccggatggtgccgatcactttgaatacgcctaagccgcttgtcagagtcaacggaacgcgtattattgattcacttcttgatgcagtggtagaagctggaattcctgagattgttattgtgcgtggatatctgggagaacagtttgatcagcttctttataaatatccgaacatcagatttgttgagaatccgatttataatgaagcaaataatatttcctccgctgtatgtgtcagatatcttctgcagaatgcgtatgttttggaagcagatttactgctccgtaataaaaaactgatccgtaagtatgaatatgaaacaaatttcttgagtattccggtggagtccacggatgactggtgttttgcaaccgatcataatggtgtgatcacagaagaaaaagtaggtggtaccgactgtcatcagatggttggaatttcctactggagtgaagcagatggaatcaagcttgccaatgacttaaatgaggtttatttatcgcagggtggaaaagagcgctattgggagcaggtgccgcttgtttataaaaaggaaaattaccaggtgcatgttcgtgaatgtattgcagaggatattacagagattgatacatttaacgaattaaaggcgattgataatcgttatgtcacaggttgataaaagcgacaaatgtgagcaataaaaaatgatgatcagagacagttctttttgctgtcatggttagttgaaactgtgattattacaaagtcatcgagagttaatttttcgggaagttcacaagtattcgtagttcttatattttgtctaaattcttgaaattaaagaataattcttatataaacagaaaattataaaaatatagaaaattgtagatgaaataagttgtgtttgcactgaaaactcgctatattataagtatcaaatacgaaaaagagaaacgggtgaaatgcgatatggcagtatatgttgtcggtgattttttgagagaaaccaggttgagaaaaggatatacacaggaagaggtcagttacggaatctgtacacctgcgtctttgtcgagaattgaaaatggtgcacaaaaaccgggacgacttattttggagaaactgtttgaacgattgggtacggagaataatttgtttaattcttttgtgagcagggaagagatggagttgtattctgcgatacaagagctgattagaaatgtgacagatgcagaaatagataaaattcataaacagattttgattgtagaaaaattgacagaaaacacatctgatttagagcgtcagtgtttgttatttgcaaaaggtgaattgataaaacgtaaagaaaaagattactcgacagcaatagaatggcttatgaaggcaatacatattacattgccagattttgatggagagaatccattaagaaataatttacttacttttgatgaaattatgattattaacggtattgcaattttacatgcaaaaagtggaaatgttatgactgcaattcaacttgatatgtggcttaaagaatatatggaagataaaattgtagacggaacaatgaaaaaagctaaatatccaatgattatatataatttaagcaattggtttggaaataaacaatgtcatacagaagcattaaaattggcagatgaaggtataaatttttgtgttaagtatggaaatcttgtgattcttccgtcacttattttaaataaaggagttgcattagcagaattgggagatatagatgatgcaagaaaatatttgcaccaagcaattacaatttttgatgtgatgaaaaaagaagaaacaattcaaagtgtacttgattggtgcaaaacacgttataatttagagatttaatatccaccagatatgtcatctaaaatgtatttggctacttcataggaattatcagatggcttctgagtacttccaacaatagaagtagctgcaataagtgcacataatgtgatagcaaaaattttctttttcatggttttgtacctccagttaattttgagattatggtaaattccagaaggcaaagagaccattcgatgtgacgtaaatttaaatttacgcgatatcgaatggtctttttgcatgaatgggaataaaattaattaatttaacaggatgctttggggattagggaaactgttaaaagagattgaaggaaatgaaaggaagatgtgagttatggtaagaccaggattacgtcgcagcgaaattgattgggagaatgtagacattcatatctccagagaagaaatggagagagagcaggagcatgaagcggcaatacagcaggcaaaacagtatctgatcaaaaactttccgaagttttgtacaataaataatggttattatgagacagagacgtttaatcatgatgcagggatgtatgaagtaatgcatgtggatcatatcgtgattggtgatcaggcaatctatgtgatcaagacagtgaagtttccggagcatgtcgaattatacggaagctcagacgcaaaaaactggtattatgcagaaaacacagataaacaggaaacgcataagcacaaagtggacaatccagataagagaaaccagagttattgtgagtatatacagatgttggcgggagaagctatcagacgggatgtgccggcgattgcaattgtcaatattattggacttacagatgagcagatccatttggatatagaatcagggcatgaggttgtgacaatggataaactggcagacaggatccggtattatgagagtacaattgacagtgatcgtgtggcgtatgaacatagcgatgatctgataagaaaattcaaggaagaagaggtgtatgataatatcattccgcagatacgggatgtggagttgaaatacagaatttatttaaaactatcggaatagattccagtaagattttaagcaaatcttaagatgaaatcattgtttacaggtttacaagtttccttttatttgataaaattctattttggtatgtaagaataaaataggtgtcttaatattttgagatgcggtcactttaggaggaaatgatgagttttattaacacggtgtttggtattccacttggatacgtcatgtggggatgctatcagttggtgaaaaactatggtttatcaatcattctgtttacattggtcagcaaaatcgtcatgctgccggtatctattatggtacagaaaaacagtattcgaatgatacagatccagccacagataaatgagattaaatataagcatgcaggcgataaagatcgcattgcggatgaacagatggagttattcaaaaaggcacattatagtccaatgcttggtatggtgccaatgttattacagattccattggttcttggtctgattaatgtcatttataatccaatgcagcatttgatgcatatcaagacatctgtctgtgatcagatcgtggcagctacctgttctctgatgggtgtagatcaattggggagcggcgcacagcttcaggcaatggcagcattgcagaatccggataacttaagctttttccagagtgcattgacagggacaggcattgatattgaggcgatcgcagcacaggcagctacgattaacacacattttcttggtctggatctgtctgtagtgccacacattactgtattggcatggatccttcttattccactgttcagctgtctttctactgttttactttgtgcatgccagaatcaggcgaacgtgttgcagaaagagcagggtgctttgggacaatggggagtaacaatttttacagttgcattctcaacatattttacattcctggttccgggtggagttggtttgtattggattttcagtaacttgttctccacagcgttgatttacattttaaatgcagtttacaacccgaaaaaatatattgattacgaggcgttggaggaaagtaaacgtctgctggcagaacagaaagcggtagaggatgcctataagaaaaagatggctccttataaggctaaggaaaaagaggactataagaggttttttgccaaagacaatgaaaataaacagttaatgttttattctgaatcctcaggattttataaatattatcgtggaatgatcgaagagttattggaaaactcggatattgtgatccattatgttacaagtgatccggaagatcaggttttccagatcaggcatgagaggtttaaagcatattatatcggagagatcaaactgatcactctgatgatgaaactggactgtgatattgttgttatgacaatgcctgatcttgaaacttatcatatcaagagaagctatgtaagaaaggacatggagtatattcatgtgccacatagtattgacagtatgaatatgacgtatcgaaagggaagtatcgatcattttgacactattttctgcgtaggtccacatcataaagatgaggtagagaagatggaagaaacctatgatcttccgcataaagtattgttaaactggggttactgcctgctcgatgatatgcgaaaagattatgagtcaaaagaaaaagtgatcaatgaacagaaaactatcctgatcgctccgtcatggcaggaagataatattgtggattcctgtctcgaggatattttacagaaattgcgggctacaggatataaggtgatcgtgcgtccgcatccacagcatgtaagacatatgccagagaagatgcaattattaaaagataagtttgcagaagataagaatattgaaattcagacagatttttcttcgaacgatacagtatttaatgcagatctgatcattacagactggagtggtattgcatatgaatatgcgtttacaacattgagaccggtattgtatattaatacgccgatgaagatcatgaatccagaatatgagaaaattggggttgtgccaattaatattttcatgagagacagcatcggatgcagcctgaatctggatcagttagaccgtgtagcagatgaggcaacgagattgatcgagcagagagatttataccacgataagattgatgcttttgtgaaacaatatgtatatcatttaggaaccagcgcaaaagttggagccaattatataaaattacgtttaaaacaaattcattcagaagaataaaggagaaaagattgatgaaaaatttaatgaaacagattacaaagaacggaagaattttttgggtgacttattttactttctttcttattttggcaatgccaacgcatgcatgggcatatgttgatccggcaaccttaacttatgtagttcagattattgcaggtgtttttattgcgggtggtgttgcagttggtgtatactggagaaaaatcaaaaagcttttctctaaggacaaaacatctgttaagaagcatgagtcaacagagcaggaaagaaatgcagcagcagcagcggctgaggaatttaacgaagacaaataggaatcgtatcattcagagagaggaatacaaatgaatatcaagaggaatattttattgaatccgggaccgtcaacaacgacggacacggtaaaaatggcacaggttgtgcctgatatctgcccaagggaagatgaatttgctgaaatgatgagacagatgaggaaagaccttgtgaagatcgtacacggagatcctcagaagtatacttcggttctgttttgtggttccggcacattgaatctggatgtatgtgtaaattcacttcttccagaaggaaagaagattcttgttgtaaataatggcgcatatagcagcagagcagttgaaatctgcgaatattacggattagatcatatcaatctgcagtttccaatcgatgaacaaccggatcttaaagtggttgaaaaaacgatgaaggaaaatccggatattgctgtggtatatacaacacataatgaaaccggtacgggtgtgggaaatccgattcgtgagataggagcaattgcgcatgcacacgatgcgatttttattgttgatacgacttcgacatatgcaatggttccaatcgatattgaaaaggacaatatcgatttttgtatggcatctgcacaaaagggattgatgtctatgacaggattatcttttgtagttggtaacgaagaaatcataaagaaatccaaggattatccaaaacgttcctattattgtaatttatatctacagtatgaatattttgaaaaaacgggtcagatgcattttacaccaccggtacagacggtatatgctacccgacaggcattaaaagagtattttgctgagggagaagaggcaaagtgggcacgtcattccagagtgatgaaagccattcatgagggactgaaagagcttggatttaaagaactgatacgtcctgaaattcaaattggtctggttgcgtcggcagtatatcctgatgatccgaattggagcttccaaaaagttcatgactattgctatgagcgtggatttacgatttatccgggaaaagtgacgactactgatacatttcgattgtgtgcgttaggagccatcgatgtggaagacattgaagagttttttaaagtgttgagggaagcacttatagaaaataatattcaagtgccggtacaatacagatagtgaaaggatacaatatgaaaacagtatatatgtgttttgctacagacgtgatccatgaaggacatatgaatgtagttaaaaaagcaaaagaatacgggaaagtcgtagcaggtgtattatgtgatgcagagatggtccgttataaccgttttccgacagtaagttttgaagaacgtatggcaatggtgagaaatattccggaaattgatgaagtgattgtacaggataggattatgtatgataatgtcatcaaagaattaaaaccggattatgtcattcatggtgataattggtgcgatggaccggaaaagacgattcgtgaaaatgtaattgctttgttgaaagaatatggtggagagttaatagaggttccatatacatataatgaaaaagtaaagaaaatcgatgatcagtttaaggaaaaactggcaatgccggaatatcgcaggaaaagattaagacagttgataaaaacagtaccaattgttaaaacgatagaagttcactccggattaacaggtcttattgcagaaaagacggtagtggaacatgacggaggattggaccagtttgatgcaatgtggatttccagcctttgtgattctactgcaaagggcaaaccagacattgagcttgttgatatgtcttcacgtctgagaacgatcgatgatgttttagatgttaccacgaaaccaatcattttggatggagatacaggtggattgatcgaacattttgtttataatgtccggacattagaacgtatgggtgtttcagcagttattattgaagacaaaacaggcttgaaaaagaattctctgtttggcacggaagtagaacagacacaggattctatcgaaaatttctgcgcaaaaatcagagctggtaaaaatgttcttcgtacagaagaatttatgatcatagccagaattgaaagcttgattttagagcgtggcatggaggatgcgttaaccagagcttttgcatatgtggaagcaggtgctgatggcattatgatccacagcagaaagaaaacagctgatgagataatcgaattttgtgacaagtttcgggcaaaatattctgatataccgattgttgttgttccaacatcttataattatattacggaggcagaactggcggctcatggtgtaaatattgttatttatgcaaatcagttaaccagaagtgcatttccggcaatggaaaatacagcaaaagaaattttgaaaaatcatagggctctggaagtggattcaaaacttatgccatttaaagatattattacattgatagatgaattgtaatttaaaaatggattacgaatattgatgtagtggtataataacttttgatgaggataaaagagatgagagtagaaacattatttgatatattagattctgatttttatacgggagttccggattcacaattacaggcattatgcaattttctgatcgataagtacggaatttctgaacatcatgtgatagcagccaacgaaggaaattgtactgcacttgcagctggacattatcttgcaacgggaaatgtacctgttgtatatatgcagaacagcggtattggaaatatcattaatccggttgcatctttattgaatgataaggtttatgcaatcccttgtatttttgtggttggctggcggggagagcctggtattcatgatgagccacagcatatctatcagggtgaagtaaccctgaaacttttggaagatatggatattgcaacttttgtaataggaaaagagacaacggaagccgaattatatgcaaagatgaaggaattccgtaatgttcttacaaatggaaagagcgttgcttttgtagtgagaaaaggtgctttggaatatggtaataaagtcgtttattccaacgaatatcaaatgaaacgagaggaagttcttgaacatatcgttgcagtaactgaaaatgacccgattgtcagtacaacaggaaaagcaagcagggaattgtttgaaatccgtgaaagaaatggacagggacatgaatgtgattttcttacggtcggttctatgggacatagcagctcgattgcacttggtatcgctatgagcaaaaagaatgaaaaaatatggtgcgtagacggagatggtgcatgtctgatgcatatgggttctatggcagtattggcaagcagaaaaccggataatatggtacacattgtgttgaataatacagcacatgagactgtaggcggaatgccgactgttgcaggaaacatagatcttgtcacaattgcagaaggctgtggatatccttatgctgtatgtgttgataatttcgctgatttagataaggaattaaaagcagcgaaagaagcaaagagtctccggtttatcgaggtgaaatgtgcacttggttcccgtgcagaccttggcagaccgactacgactgcgattgagaataaagaaagattcatggagagattgaattgaaatcatatatcgtaaaacagaaggacctgaatagtcgtatgctatccaggtccggtggcatttttgcagcaatatctgaccaggtgttagcacaggggggggtgatttacggcgcaggaatggacaaaaattttaatgttgtacacaaacgtgctgtaaatgcgacagagagagatgaacttagaggatcaaagtatgtgcagagtgacatgcacaatgcatatcggcttgcctgtgaagatttgaaagccggcaggttggttctgtttacaggaactccatgtcaggtggatgggataaaggctttgtgtccaaaaggttgtgaggaacatctcatttgtatggatatcgtgtgtcatggtgttccgagtccaagagtttggaatgattataaggcgtatgtggaacgaaaatatcatgggaaaatagaaaaaatagattttcgtaataaggaacgcttcggatggtctgatcattgggaaacagttacaattaatggaaaagagcatgacagtcaggtttatatgaagatgttttatgaacacacttttttacgtgaggcatgctatgtatgcccatataagaatctgcagcgtatatctgatatttcaatagctgatgcatggggagtagagactgctaacccggaatttgatgataataggggagtttcacttgttcttattaatacacaaaaaggagaaaaatggtttttggattccctgcaggggtgtgattttaaggagtgcgctttagaaaagtatatgcaggaaccacttaaaggaccatttaaaaaaccagataatacagaaaatgtatggaaagaatataacgaggtttcatttggaaaatttgtaaaaaatcattataaagaaccgtttttgtcagttgtcaaaagaagtttgaaaagaaaaataaaggatatgataccgaaagaattttggaatcggctcagaaggtggaggtaatatatggaagaaaaaaggctgccggatttatgcacaaaaaaggatacctgctgtggctgtagtgcatgtgccacgatatgtccggtgtgtgcaatttcgatgtgcccggatgaaaaggggtttttatatccactggtaaattctggtaaatgcataagatgctataaatgcgaacaaatttgtccgtttaaaaaaagataatttttaatatattcttaagtagcttttccattcataaatcatgtgctacaatattatcagattaactatatatagggtagttatgaaaaatattaagatatgagaggtatttacaattgaagaaaagagcacttttactaggaatgatgctgacgcttgcagtaacttcggtaggatgtggtaagaaagaggcagatgctaatatcacagaaccgatttatgaagaatccagcgaagaggcagtcgttggggatgttgtagacaatgaggaggaagaagatcttccggatggtaaagtccgtaatgagctgacaggagaattaattgatgagtcacttgcaaatcaaagaccgattgctgttatggtagataatgaatcaattgcattaccgcactatggtctgacacaggcagatgttgtttatgagatgatgaacagtactgagaatggccgtattacaagattcatggctttagtgaaagattgggagacattagagcagtttggaagtattcgcagcgcaagggtaacaaactgcattctggcagcagaatggaatgctgtattatgtcatgatggtggaccattctatattgacgaatatattgcacttccaagtgtggatgattttaatggcggattttcccgtgtcaataatggaaaatccagagaatatacagagtacattgtttcaggtgatctggacaaaaaatttgcaagcacaggtgcaagcaaagagtataataaatattatacagaaaatcactttaaattcgccaaagaagacactgatattgcggatggaacatctgcagttacagtagatattccatttcctcataatggctcttatttgacatatgacgagtcggagaaagtgtataagtactttgagtacaagaaagagcatgtggatccacagaatggcaatgctcaattgagttttaaaaatgtgattttacagtgtacaccatttgaattacacagctggggtgacggtgtatatgatccaaacggttacatgtactataaaatcgagaataataagggaacaggttattatattacaaatggtaaagcagaagagattacatggtcaaaaggcggattgacagataacacaaaatattatgatgcatccggcaatgaaattaagattaatattggtaaaacatacattgcattagttccggatgatgcatggggagatcttgtagtagaataagaaatttcttagatataattagtccagggaaaacacgggataaatagtgttttccttggatttttttgttataatgaattagtatgggaaagttctgacgcttatagaaaatatgaggaatacagattatgaaaataaagacatctgcaatagtttatggaatccgttatatcagaagatttgggctgcgcactttgataattagaattatagaaaaaaagagagaaaaggattctgagtatcagagtttttatttggaaacgaaagcttctctggaacagttagagaaacagcggatggaggttagtcattggaataagaaagaaaagattagtattgtgacacctctgtaccatacacctgcgatttttttgagagaattaatcgagtcagttttagaatcttcctatgaaaactggcaattatgttttgcagatgcaacgcaggatggagatgaaaatcaaattgaaaatattgtaaaagaataccagaaaatggatgaaaaattaacaggaaaaaaatcacgtatttgctataaaaagttatctcaaaattatggaatagcagaaaatacgaatcaggcgttagcaatggcggagggagattacattgcctttttagatcatgatgatataattacaccagatgcattatatgagatggcattggcagcaaaatgtgcgaagaaaacagggaaagaggcaaatatgttttattcggatgaggataaggtcaatgagaatagaacggcttttttcgaacctcatttcaaaccggattttaatcaggatcttttgaattccaataattatataacacattttttgatggtcagcagagaactgctggatcaggtgggcgggataaacaaagagtatgatggggctcaggactatgattttatcctaagatgcacagaacttgcagataatgtgattcatattccaaaggttttatatcattggagagtacatgagcgatctacagcagcaggtgctggaagcaaggattatgcaattgatgctggaaaatgtgcgatagaatcgcatttacagcggatgggagaaaatggcaaggtggttgtcaccccttattttggcttttacagaatagaatatgggataaacaccgaaaataagacagaagattacgttttgtttgcagatcaatctttgaaaccattaaatgcagactggaagcagattttatatgcagattgcagccgcaaaaaaattggagttgtaggaggaaagatttacgacagacatcatcgcatttatgaggctgcatttttggaaaaaggtgattggacaggtgctgcatgtggtgaaaatgtattttctggcttacgagaaggatatggaggttatatgcatagagctaatatacaaatggattgtgacagggtttctgaaaaatgtatgttagtaaaaaaagaagtgttggaacagattgaggattatgaacaacaaatcagaactccggaattttcgtatatagtttgtcagaaagcaaaagaaatgggatacagaattatgtatgaaccagaagtaaaaatgatttttaaatcatgaaaaaatatgtataataaaatatgtatgtgcaaatagtgtcaggatttgtcgtacaaaataagtaggaagctcttttttgttgtgatataatggaattattctaaagttgaaaaagaggacaagtgcttatgatgagggtatatatatgtccggactgtggctggatgcgcatggtttcgcggcgtaaaaatgtagaatgctataagtgtggtgtgcaggatatgactttggcaaaagtagactttgccacatatgtatcctggtctgaaaaagaacgtcaggaatattctgcggcatggatgtacatacataacaaaggaaaaataaaaaggaattagaaaataatcatgcaggaagtgacaatcataatcccaaattataatggaaaaagcttactggaaaattgtttcaggacattagaaaatcaatcgtataaagactttaaggtattagtggttgataatggttccacggatggaagtacagatattaagtccgatgttttagatgtggaatggattgctttgaatgaaaatctgggcttttgcggtgctgtaaatctggcagtgcaaaagacaggaacgccatatgttattctgcttaataacgatacagagacagataagtattttgtggagtggttgttaagggggataaaaaagtcagaccatattttttcatgtggagcccagatgatagattataaaaatcatgaaatattggataatgcaggggatttatatactgctatgggatgggccgttgccagaggaaaaggcagaccatgtaaagattatgaaacgtcaaagcgggtgttttcgtgctgtgccggagcagcaatatatcgcatggatataatgcgaaagatcggaggattggatgaaaagcattttgcttatctggaggatgtggatttaggttatcgggcaagaattgcaggatttgaaaattggtatattccggaggcgaaggtttaccatgtcggaagtgcgacaacgggtacacgatacaataagaaaaaggtatttttagcagcaagaaatactatttttgtgatttataaaaatatgcctgttttacagttggctttaaatgtcccatttatttttacaggtatgttcatcaaaacacttttttttgtcagaaagggatttggagaagactactgcaaggggattttagaggggatttgcgattgcagaaaatgttggaaagtgaaatttcgtataaaaaatctttctaactattttaaaatacaattggaattgtggtgcaatttagtgcgcataatataggtaaaaggacattatcccggtttgaaacaggagatgtctgtgaaaataaagaaataattaagattttggagcgctcgttttaagaaaatagagttgtgatttcgggtaaattattgtatcattgaaattatgatagctaagaaaaggatggcattatgataaaagataatcagcagcattttaatagattgcatgttgttttggatggattggttgtcattgtttcttatgcacttgcctggtggttaaaactttcagggatttttacaaacgatcatgttggagttctttcatttgaattctatatgaaagctctgatttttattgttccactttatttgctgttatattatgcgtttaatttatatacgccgaagagagcacagggcaggcggcttgaattatccaatattattatggcaaatacagttggaattttaattgtgtttgcaggatttttccttgtattgtcttatacagaagaggcaaagaacttctcgcgttccatgtttgcatatttttatatattcaacattgtacttgaagaagtagaaagacttgtagtccgcggttttttacgtagcataagaagaaggggatataatcagaagcatatcctgcttgtgggatattctaaggcagcagaacagtatatagacagaatcaagcagaatcctcaatggggttataatatacgtggaattctggatgataatattgcacgcggaacagtttataaaggtgtgaaagtaataggaagtattgagaatctgacttttattttgccggaaaataaattggacgagattgcaatcacgcttgggttggaagaatactacaaattagagaaaatagtatcacagtgtgaaaagtcaggagtgcataccaagtttattcctgattatggcaatattataccgacgagaccatatacggaagatttgttaggtctgcctgttatcaatatacgatatgttccgttgtcgaatacgtttaatgcaatggtaaaaagactgatggatatcgtaggatccataatatgtattgtgattttttcaccagtcatgttgctttctgcgattctcgtgaaaataacatcttccggtccgctgatatttaaacaggaacgggttggacttcataatgaaaaatttatgatgtataagttccgaacaatgtatgtgcagacagaggaagaggagaaaaaaggctggacgcagaaaaatgatccgcgtgtaacaaaagtaggaggttttttgcgtaaaacaagcctggatgagttcccacagctttttaatgtgttaaaaggagatatgagtcttgtaggaccaagaccggagcggccgcagtatgtggagaagttccgggaagaaattccaagatatatgatcaagcatcaggtgcgtccgggaatgaccggctgggcacaggtgaatggatatcgtggagatacttccattcgaaagaggattgaacatgatttatattatattgaaaactggacattaggattggatattaaaattttattccttacagttttcaagggatttatcaataaaaatgcgtattaggagaaaataattaatgagtagtgaaccaaatcacaatcgacaaaaaaatcataaagctttaacaaagaaacagaaagaagcaataagaaggaaaaaaagacaaagaaagatcatattactggtcgttgagatattagttgttttaattttagctattgcattgtttttaatcagtaaattgggaaaaatcgaacgtcaggaagttccacttgaaaacatcgaggtgaatgaaggtatttcagaagaatccaaggagattatgaagagttatactaccattgccttatttggtctggacaaccgctctaacggtaatttgtcaaagggacgcagcgatgtcattatgatcgccaatatcaataatgacactaaagaagtcaaattatgttcggtattccgtgattcttatctggatacaggagatggaagctttaagaaatgtaatgccgcttatgcaaaaggtggtccggaggcggccattaatatgttgaataagaaccttgatctgtccataacagattatgtgacggtagattttaatgccgttgttgagtgtgtggatctgctcggtggtattacactggatgaagtcacagatgaagaagcagttcttatgcagggatatatggatgaaatcaataaacttaccaagaataattccaagtatctttccggtggtggaacaaacgtgacattggacggcgtacaggcatgcgcatatgcacgaatccgttataccaaaggcgatgattataagcgtgcagagcgtcagagaacggttcttgcggcaatggttgcaaaggctcagaaatctgatcttgttacgattaataagctgatcgatgcagtatttggggatattcagacaagtttttcgaatgcagatttagttgcattagcagcacaggtatttaattacaaacttggcgagacatcaggatttccgtttaaccatggatcaacaactctcggatccaaaggaagtgtggttgtaccttgtacattggaatcaaacgtaatcgaattacaccagttcctgttcggtgatgaggaatacacaccatcggataccgttcttgcaaacagtaagaagattatcaatgacacaggtatgaatgagggaagtggatacagataaatgacagtagatattatcattccaacttataaaccggatgaaacattatgtctgctcctgcacaaattgcaggggcagacctttgtcgttcatagggtaattattttaaatacggaagagaaactctggaaacaggcagcagcagcttatccgattgaacaggtattgaaagaacttccgtgtgagtatgaggtatttcatattgcgaagaaagattttgaccatggtgggacaaggcagtttggagcagaacattcggatgcggatgtgatggtttttatgacgcaggatgcagttccggcggatgagtttctggtagaaaaattagtggagtcattgcttttaaaggaagatcaggtgtctgcgcgggtacagcagaatgcaatggaagtgacaggcactgaaaaaagtgcagtaaaagattgtttagttgcagtggcttacgccagacagcttccgaaaagtgactgccatattgtcgagcagtatacgaggcagtttaattatccggagcaaagctgtgttaaaacaaaggcagatattccgacacttgggatcaaaacgtttttctgttcagatgtctgtgcggcatatcgcagggatttatttgaagaactggggggatttgagtctccggttatttttaatgaggatatgttttttgcagcaaatgccatcgaacacggatatggcgttgcgtatgcagcagaagcaaaggtagtacattcacacaattatacgatgaggcagcagtttcacaggaattttgatctcgcagtttcacagaaacagcatccggagatttttgaacaggtgagttcagaagccgagggtatgaagctggtgaagagtacgatcgcttatctttttgcaataagaaagccatggcttgtttttcattttggtatgcagtgtgttggaaagtatgcaggtttctggatgggcaggcattatgagaaactcagcaggaaacagattttaaagtatacgatgaatccgggatactgggatatgagagaggatgttcatgagtaagatattatatatggtagtaccttgttataacgagcaggaagttctgccggagacatcaaaaagattattagaaaagctgcaatctctggtcctgaaaaataaaatagcggataacagccgtatcatgtttgtaaacgatggttcgaaagatcagacatggagtatgataaagggattatgtgaggaaaactctgtgtttgccggagtgaatctttcaagaaacaggggacatcagaatgctcttttagcgggtatggctacagcagtaaagtatgcagatatgatcgttacgatggatgcagatctgcaggatgatattaatgcggttgaccgtatgatcgatgcttattatgaaggaaatgatgtagtttatggagtgcgttcttccagaaaaaaagatacctgttttaagcggggaacagcgcatcttttttataagctgatgagtttccttggggctgacattgtgtatgaccatgcagattatcgactgctcagcaggcgtgcgactgaaaatttgttggattttgatgaagtgaatctgtttttgcgcgggatcgtaccaatgatcggttttcagagcactactgtggagtatgagaggggagaacgttttgccggggagagtaagtatccgctcggaaagatgatcacatttgcgtttgaaggaatcacttcactttctgtaaaaccaattcgaatgattacaataggcggtttactgatctgcctgatcagtctgataatgctaattaagtcttttgtggattattttaatggaaatgttgtcccaggctgggcaagtattatggtttcaatttgggtgcttggcggcttgcagatttttgcaatcggtattatcggtgagtatatcggcaaaacatatctggaaacaaaaaaaagaccaaagtatattattgagtcggtgattttagatgacaaggatataagcatagaccgtaatttgtaaaaaatgaactttggtaattcaacaaattttgctggattttttagaagagaaaaaagacattaagggatttataaatattatagatatgagtgcagacaaagaaaagagcaagacaaatcaaaaaaaaatagtatggatattttgggcgttcatggcaatcgctatttttctggttttaaagcagatgggttattccgatggcgatgatacctatttttaccattattcgaccaccatgggatttttcgagtacttatcctggcgatatcagacgtgggtaggacgaatggctgcagaagcaattgtatatattacatttaatcttggacttggattttggagagttgcagatgcggttatgatggtgctgcttccaatcggaattttaagattgggatgcaagacggcaggctatacgggatatacagctttgctgaatgagtatcaggaaggtgtgggagctgacacagagcagcacaatctcagagaaataaccggttggcgtaatatctggaaaagcatccggtatccggttttacttgcgagtggatatctgttgatgagtgtcatgacattgggatattctgcggtctgggtgaatggttccatattttatacatggacgttcacagcaggtgtctgggcgatgatgcctcttgcggatcttgtgtttgatacaggggcgttttcgaacaggcaattgatctatgcgcttccatgcagtgtcattgcagcgatgtcgatcgagcagatgggagcagttttactcgcatttgaaggtctgtcaattttaagtcttctgttacagaaaaaaagaataccggtggcgatatggatccagacggttataacatttgcagcatttgtgatcctttttatggcacctggaaatgacgtgcgtgtggcatcagaaattgcaacctggatgccagggtacaaagagttatctgtaggaaatcatttatttatgaccatccagtggatgttatcttcctttgcaaatgagggaaaggcattttttattgcaatctgggcagcagggttccttttactggtaaagtcaaaaaaagcaaaagtttatcagtctttagcagtcgtttttagtgtggtggcacttcttccttatgccggcatttcttttttttcggagatgggtattggatatattgatatcgagcagtgcctcactgaactgccgacatggcagacgatgaccacacagaatcggattgcctttttctggtggatagcagcagttctttttactctggttttattgtggaaagtgacaggacattctgtttttatcagcatggcttttcttgggggaattgccagtgaggcagtgttacatttctcgccaacgatttatgcgtcgggtgcccgtgtttattatctgacggatctcatgtatttatttattattttgtggatggtaatgcgcatggatagtgaaaaaaagaaaaatttattcattgcaggagctgcggctctgggtattataaattttctgtcacagtattccatcatgttattaaaactgtaacattcatttttaaatgaaaatccaaacttcctgtttctccggttttagaaaaatttgagagataggaagtttttatttttaaaaaacattttttcttgatatttttatcacaattcgaacacaatttgacgctagactaaggtcataaagataaaggcagcagataataagaagctgcacagaaaggggcaaattgttatggataacaattattacaacaatagtaacaataacaacactaacagcaatagcaactataataacaataatagcaataataatagcagtaatcagtattctgattctttctactcatataataatcagcagaatcatggaaatcagaacaatacacagaacgacagtacagcatcccaggcaggcggatatggctccacacagagttctatttatggaggtcagaacaacagtcatggctctggttatggaacgacacagaataacagccagagcacaggatatggaaatgctcaaagcaacaatcagagcactggatatggaagcacccagagcaacaatcagagttatggatatggtagtacccagaataatcagcagagcgctggatacgaaaatacaaagagcaaccagcagaacactggatacggaaccacccagaacaatcagcagagtacaggctatggaaaccagaacagtaactatggaacatatggaagcaataccagttatcagagttatgcatatggcagcaatccaaaaccggagaagaaaaagaaagaaagaaaaccgggtggatttggaaaacagcttgcaaaatgtgcagcacttgcacttgtatttggactggttgcaggcggtgtcatgacaggtgtcaattatgcatccggaaaaatttttggaacaacaaatgcaagcaatgtgcaggcttcattgactaccggagatgattctaccgtacagccgacagcaatctcatcttcctatgtagcaacagatgtttcagatattgtcgatgaagtaatgccttctatcgtagcaattacaaatgtaagccagacagagtatcagagtttctggggacaatccaagacttatgagagcacaagctgtggatcaggtattattgtaagtcaggataatgagtatctttatgtggccaccaataatcatgttgtcgagggagcaaacagccttactgtaactttcgcaaatgatgatacggtcagtgcagagattaaaggtacagatccttctacggatcttgcagttgtaaaagttgccctgagcagtattaaagatgatacaatgagtgagatcaaggttgcaacacttggttcttctgatacattaaaagtgggtgaatcctgtatcgcaatcggtaatgctcttggttacggacagtctgtaacaaccggtgtgatcagtgcattaaaccgtgaagtttctgtttcagattcctccagcagcaccaattatacagcagaactgatccagacagatgcagcaattaaccctggtaacagtggtggtgcattattaaacacagcaggggaagtgatcggaatcaactctgtaaaatattcagacacttctgttgaaggcattggatatgcaatcccaatggatacagcaaaaccaattattgaagaacttatcacaaaagaaaaagttgacgaatccaacagtgcatatctcggtatcgtaggtgtagatgtcacaagcgatgttgcaaaaacatataatatgccaaccggtgtttatgtcgcacaggtcatggaaggagctgccgcagagcaggctggtatccagaaaggcgatattatcacaaaatttgatggaaaagatgtcacttccatggaggagctttcttacaatatgcagtattatgcagcaggtactacggtggatgtggtgattgaaagatcatccaatggacagtatgaggagcagacaatctctgtcactcttggtaagaagaattaaacctgagtttgacggacgtagtgtcgcagattctgtggtgcttttataggttgtgaagggcagatataagtgcctctcacaagtcagaattttatatgtaatgaaaaagaaaaacggtataaacgaaatattatgtttctgttcgctggacattccgataggcttctgagcaacaatcttgagaagcagtgcttcccaagattgttagaatcctatctccatagctcacaaagaaaataatatttgtttataccgtttttctttcatttacgttgtgtgtccagcgaagctggaccacactagccggtgtaagtccggtcacggtaatcgccagtgagccgtgtagctaaactcggtgcgttgcagtaatgcagggtactaagcgagtggataaagtaacctcggtaagaggggcgagcaattatgcagaccgtaacataaagtgaattctgccgtatcgttagaaaggtctctgaaaagagagcaaagggaagctgaaccctgggcgtatgggtgaaagccatggaacgtgtgaagaaactggaaagcagcacggaggaatccctcggtatataggaaacggtatgtatgaaaagtgtggttcggaactggagagaccctacccatcaccgaaaggtaaaaagaaagcgtataagcttggcgaaatcgtatttctgatgggagggagtcggagaggaacatagtaccgataatgactgtgcaagaaaacgcagtctatgggaaggttccttgcttcattcatgtttgtagagagggtaagagtgagagaatgtcatgcagactaataactccaaagaaaaagttcgacaacttcaaaacaaactatatctgacagccaagaaatgtgatagccgaagatttcatgcactttacgataaggtatatcgtgatgatgtactttttgaagcatggaaacgggtaaaagctaacaaaggttccagtggtgtagatggtatcggaatcgaagatattgaagagatgggaattgaaaaatacctgtcagaaatcaaatcggaactgatggatggaaagtataaaccatccccagtaaagcgagttatgataccaaaaccagacggaagtgaaagacctcttggaataccaacagtcaaggacagaattgtgcagatggctgccaagatagcaatagagccagtattcgaagctgactttagagattgttcctatggattccgaccgaaaagaagtgccaggcaagcactggaagtggtaaggaaagcgtgtaacaacaagggctattatgtagtagacgcagatattgagaagttctttgataacgtaaaccaagataaactgatgaaactggcagagcagagaatatcagaccgtaggatattgaagctgataagacaatggttagtatcaggagtattatacggaaatgtactgacaatttccgaactgggaacaagccaaggttcagttatatctccgttattggcaaacatctacttaaatacactggacagactgtgggaaaagtatggacttactcacggtattcttgtaaggtacgcagatgatacagtcatcatctgcaagaataagaaaaatgcaaatcacgcactgaacttattgcagtacatcatggcaaaactggatttaaagctacacccagtaaaaacaaagattgtcagcatgtgggacggaaaagagggatttgactttcttggaatgcaccacagaagaatgacaacggaaacaagcaaaggacaattgtataaagaaacttatcagtacccgagcaggaaagccatgaagaagatgaaagcagaaatcaaaaagaatgtaaacggtcgaagtctgttagttgcaaaggaagaggatttaataaagaatctaaatccgaaaatcataggttggaagaattattattccaccaaaacaaatgagacatggatgcaggaattagactggtatattatctgcacctttacaagatggtataacaagaaacaccaaaggtgtaaacatatgtcaagagtgggatttgttagaaatagcatttacgaaaaaggattaaagaaaatggctagagcatgacgtaatgctgtagaaagaagaatgtcggaaagccgtgtgagggagaacctcatgcacggtttgatgaggggcggatgaaattttcatccgcctactctacacgaatgacttgtgagaggacgcttatacatgccaaatttacactgtgaaccgcaccacagaatctgccaatttacgttatggaactcacggttatgggatgagtgcctataggataataccaaaactcaatcagcatttttgaaataagtgaattaggatttctttaaatgaattttaacggaataaaatagaattgtatatgtgattatggtagaattatgctattaatgattttgacaatcgagatttgtaagactaatttgagcaaagcggagaaatatctctgcaatcattgacaaaaattgcaaaaactcttgacgtggaaagagaactgaaaagttatgatatatttaagtagttttagattaagtaaaagaaaagtgaataatcctaatatttatccctacaatgtattccgagataagtatattgaaccatttgtttttagacccatcactgtactttatggtaacaacggctcaggtaaatcaacactcttaaatattatagccaattgcttacaattagaagggaaagaatatgcaacaagtaattcatttggaagcgttgattactgtggtttgttttccagcgaatgtttgtatactttgggggaagacgactatggaaatacaataaaaaaattaccggaaaacagccggtatattaaaagtgaagatatattgtatgagattaagaagatacaacaaaagcagatattatcagatggcatggagtatgattatgttaagagaggcatgtctttacttgaagcaaagaaatttttagcttctaaagaagggtgtaagcaggaagaatatataaaatttgcacaggaaaaatattctaacggagagacatcaatgcaatattttgaggagtatttacaacccgatgcattatatttattagatgaaccggaggtttcactttcacctgcgaatcaggttatattagcagaggaaattaataaaatggcaaggttgttagaatgccagtttattattgcaacgcattcaccatttatgcttggaactttaaatgccaaaatatataatcttgatacggaagagtatgatgttacaaaatggagtgatttggataatgtgcgatacttttataatttcttcaaaaaacatgaagatgaatttaaagaagattatttataaaaaaatattagtatggacagatatattttgaactaaggatgttaattgatgacaagattgaaagctcacgatgattccgcttggcggaacaacagcttcaagtttgaagaggtgaacgctttgaatcttgagaaaaccaaattatattacaatcaaataagaagtggagatttatgcgattgttgtagaaactatatcacttgaagctgactgaattttgccgttatctcataggcattcatcccataaccgtgagttccataacgtaaattgcagattttgtggtgcgattcatgatgttgattgggcaaatataagcgtcctctcataagtcattcacagcgtaaatgaaagaaaaacggtacagacaaatatgatttcctttgtgagccatggagataagactctttagaggcttatcggaatgcctggcgaacaggaacatcatatttcgtctgtaccgtttttcttttcataaacctataaaatcacgacttgcgagaggacgcttatatctgcccctcacaacctataaaagcaccacagaatctgcggcactacgtccgttaaactccggtttacatgttttatattaagtgctatgatatgacacaaacagttattttgagattaatgcagggagggagtcttaatgaaggaatttttgtatatgatcgttgggtggatagcagaaatccacagttatctgatgcggttcaatgatagttacgaatataatttttcagataaagagttgcattttattgtgataggtttgcttggaatggcatttgtatttattgtttatcctgtgtttaagtggctggcgaagcacaatcatgtgatggtcatcgcctggatatatgtatttaccttaattttagtcgttacatttgcaattgaaatcggtcagaaagtaaccaatacaggtgcaatggagtttgcagatattgtgtttggtgttgttggattcatagtgatgttttttattttttctattattagggaaatctatcacttgatttgcagacttataaaatatctgcgagatcaaaattggggtaagagatgaaatatcatgaaaatacatggttataaatgaaaaaattcccgataaagtaaacactgatgataaacaaacatcgagaggcatattcctatatgtaaattggcagattttatggtgcaatgtagagggaattctaataaacttgggaaactcatgccccgattcataacgttgaccgggcatgtataagcgtcctctcacaagtcattcacagcgtaaatgaaagaaaaacggtgcagacaaatatgatttccttcgtgagccatggagctgggattctaaaaatttcgtgaagctttgcttcacaaaatttttgctcagaagcccagcggaatgcccggcgaacaggaacatcatatttcgtctgtaccgtttttctttttcattacataaagtgactgccttgtgagagggcgcttatatctgcccctcacaccctataaaggcgccacaaaatcacattctaacgttccattttccagtaagccgcactgtaaggtgcaagttcactgccaccgccaaaatcgtgtgtttctcctgtaatcagatctaccgcagtgccgcatccggcgtcaaaatgtgccataaaaggctgatcatccgcattgattgctacaagaacacgttcagaatctgtttttcgctcgaaaatacactggcggttggtcagaagaacggaacggaaatcaccgtaattcaatgcattggaatgtttttttgcctctgccagtttggaaataaaagttgtgagatcattccatttcggtttctcaaagcaggcacgcagtgcaggatcgccctcttctttgcgggcttttgcaccccattcactgccataataaacgcatgggatacccggcataccaaaggcgagagcatagatcaaaggcagatgattttcgtttgataaaatgcttgcaactctggtgacatcatggttatcgacgaaagaaagcagatgttttcctttgtataaagtccagttatccgggccaaactgacggagcagggagcggttgatctcaaacatattcatgctgttaaaactggaatacaatcccttgtaacactcgtagtttgtgacagaatgtaacatggaatcattcatccactggttataatcaccgtgaagtgtctctccgacaaggaaaaaatccggttttaatccatcgcagaaagagcggagccgtctgagaaaatcgtgatccagacagtatgcaacatcgagccgtaagccgtcaatgtcaaattcctcaacccagcctttgatgcaggaaaaaatatgctggatgacatcttcatttcgtaaattcagttttacaagatcataattgccttcccagccttcataccagagaccgtcattgtagtttgaattaccgtcaaaactgatatgaaaccagtctttgtatggggaatcccatcgtttctccaaaacgtcctgaaatgcccagaaacctcttccaacatggttgaatacaccatctaaaacaaccttgatacctgctttgtgaaggtttttacagacagattgaaagtcctcattcgtgccgagacgggtatcaattttggtgtaatctctggtgttatagccgtgcgtgtcagattcgaataccggtgaaaaataaatggcatttgccccaagtttttcaatatgaggaatccagtcatttacttttaaaatgcgatgttctaacactccgtcattttcaaaaggtgctccacagaatccaagtggataaatttgataaaatacgttttcataagcccacatattaaagcctccaaattatttcaaaatattaatggtgcagaagtaatgattcagtaaatctgcacattttgcatacagaatataaaaaatgctgcatctatttactgctcatatcgcgcgatttctgtgagcaggcgcgctgggcagaaatcacagtgttgcggaaacctccggcttccagtgcagcaacagcctcgatggttgttccggcaggggagcagacggcgtcctttaattcgcccgggtgctttccggtttccaaaaccattttcgcggagccatagacagactgggcggcaaatttataggcctgtgcccgcggcatcccatctgcgacagcggcatccgccatagcttcgataaacatgtatacataagccggagaagaaccggaaaccccgatgacagcgtccataagagattcactgatcacttccgatttgccgaaggagttgaagagtgcctgaacttcttttaattcttccggggtcacattttggttgacgcacaatgcgctcattgcctcaccgactaaggctggggtatttggcatggcacgtacaagcttgactggtttgccaaaggagtcctcgatggcggcaattgtttttccggcggcaatggatacgatcacacatcctgattttacatgagaggaaatctgtgggattacttcatcaaatttatttggttttacagcaagaaataaaatatcactgcgttctgcaaccgtttcattggacagggttgtctcaatggaatatgtactctgcagtttttctaaggtagctgcggaatgggcacttgcaatgatctgactggttgtcactaactctgagtgtacaataccgccgatcatggcacttcccatatttccagctccaatgaaaccgataatcttatctatcatatatcctccttgtttgtgtcctgtattttctttcatcctagttcatttgttctgaaaggtcaaccttttagacataattagggctggaatactgtaaaaaatgttactgttcactcgtatttcgttccagtaacgattcgcagactcatttaaagtttttgttttgcaaaaggagtctgctcactcctgaatcactttcttacacagcaaaacagcaagtgttttactgctgagtgaacagtaactaaaaaatcattacattttacagtattccagcccgtaaaggggaggaaaaaataacaaactatagttgaaatatactttgtttttatttaaaaaattagtaggctgccagaatttcttttaaggcggcgataaatgatttattctgttcttctgtaccgacactgacacggttaaaaccaaatgcactgatcataattttccgctccgcaagggcagcacggatttcttttggatcatggtgtgtgtcgaagtagatgaagtttgcacaaggttttgcaagagtgcagcctaattttgtcagttcatcctcaagatattcgcgccctgccgtggtgagagccttgatttttttgatgtattcctgatctttcaaggcagcctgtgcggcagcaagtgcattgtagctgacattccatgcctgacaggctttcattagttcatcgatcagcaatggatcagcaaaggtgtaaccgatgcggagaccggccatgccataaattttggagaaagtacgcagtacaaagagcggtctgtcgtagccttcctgaatcattttgatgaggctgtagtgcgtaggatcttccacgtattcgaaatatgcttcatctaccaccggaatgacatgatccgggagtttacggatgaattcttcgacttttgcggagtttacataagtaccggtcgggttgtttggattgcagacgatcaccattttcgttttgtctgtaatggctgcaagcattgcgtcgaggtcataacagtaatcatcggtcagtgggagaacgacacggacacctccgttatcgctgaccatatcagggaaagcttcataagttggagcacagtacaccacttcgtccccataattgataaatacttcaccaagcatatcgatgatcgcagaggaaccggcaccgatacagacatgatctacggtaagaccatagaaatcagccagctgctttttgagatcgactgcatagaaatcctgatacatatagctgttgagggaagcatccgtaactgctttttttacttcatcagacataccgtatggattttcattataattcattcgtgttacattcttcggggtggaagttttctgacgtgcaccacggttgctctttggttttgttttcatgctgtctcttaataaacattctacattcatcttcataatctccttgtcttttatatatataaattcagttgataatggaaaccggatgcccttccaggtagcaccggaaattgtcgatcgccatatcgatcgcacggatcctggattctcttgtgagccatgcgatatgtccggtgataacggtatttggtgcagttaacagtggactgccgcaaaccggcggttcatccgtcagaacatcaagtcctgcggctagtacctttccggatgcaagcgcatccgcaagtgcctgttcatcgatgagggcaccgcgcgcggtattgatcaggatcacaccgtctttcattctggcgatggtgtcctgattgatcatgcgttcggttgccggagtatgcggcgtgtgcagggaaataaaatcgcttcgggcaagcagctcgtctaacgatacctgttcaatgaaatcatactcagcacctgtttttttgtggcggctgtatgcgagcacatgcataccaaatccctgtgccatttttgcaaaagcaaaaccaatcgccccaagaccgatcacaccgatcgttttgtcatataattcaatctgtctggtgaccgatttacagaattcgttgtggttttccggtacagaccagtcaatcgttttgatccgggtgtcatgcgtgccgatatgatggcagacatccattaataaagcgaaagcgtattctgcgatcgtctgtgaaccgtagatggtattggaaatggaaataccgcgttttctggtcatttctgtatcgaatttttcccatccgtgtcctaaggtggcaacatattttaaattcggatgctggcttaaaaatgcttcattcatattgtccggaccgatccacagtccgaatgccgcgtccgcatctccgatataagtatgaagttgttctatattgggataatgggcgggaacttcaatgacaacctcatcaataccggggagctgctccagttttttccagcgttttgtaagttcctttggagtgatatctgtctgaataatttcctcctggatcacaacaattttcatttgtctgtcacctccatttgtttatgattgctaatataagttcaaaaatgttgatttgtcaagtataaatttcttgcaaattaaacaataaaacacaattgtgagacactttcttctatagttaatatataagcgtgtaatatgcgttatcagacgcaaaaatcacattttttacgtttttcacaataaaagtatagaaataatgcacattttgaaaaaagtatacaaatctataaaaattggctggattttgttgacaggaaaacaaaaagtgtgataaaacaggtttaatttaaaacagcaggcaatcaggcagcagacctgaacatagcaaaggcgctagggaatcatccttagcgccttttctgtacatagaatatatgcagagtacagatgctgttgtttacagaaaacagaagaacaatctatttcattagttcataggaaatggatgtttcttcggaataataaggaggattagttatgacgaatacacctaccacattttttggctggatcatttttctgatacagcagtatcacggatactatttacaagggctgcttaccacattggaaacatccctcgcaggtacaatctgtggatgctttttaggatttctggttggaatcattcaggcaacggacatccgggcgcaggataacatgatcaaaaagattttacttggtattccatgggtgatcgcaaaaatttatgtcacgattttccgtggaacaccaatgatcgttcaggcaatggtaatttattatggatcatctacagtattcggaattgatctgaaaccattcaatgcagcgatttttatcatcctgttaaatacaggagcttatatgtcagagacagtccgcggcggtatcaattccattgatgtcggacagattgaaggagcaaaggcgcttggaatgggatatgttccgatgatgatctatattattcttccacagacttttaaaattatcgcaccgcagatcggaaatacatttgttgcaaatatcaaagatacttccgtattaaatgtaatcgcagtcacagaacttttctatatcacaaaggttgcagccggaacatatttcagaatgtttgaggcatatacgatcacagcattgatttacctgacacttaccttattatttaacggtttgctgaagctgatcgaaaagtatatggcaggaaaagaaagttacgaggttttaaatccggcagccgcaaaataaatcaggggatcagatggaaagaaaagaggaacgtgttatggcaagacaatcaatatttaagtttaatgagagagtgacgactgaggcaaaggatgcaacgtatgaatttcgtggtccggtcatcagtgtcaggaatctggaaaagaaattcggggaacacgaagttttaaaagacatcagttttgatctgtttgagggcgatgtggtctgtatcatcggatcttccggatcaggaaaatctaccttattaagatgcatcaatcatttggagacaccgacgagcggtcagatattatatcatggctatccattgacgaaggatgcacagacgatcaaccgtttccgttcccaggtgggaatggtgttccagcagtttaacctgtttaacaatatgacggtttttgacaactgcatggctggtgtccacaaggtgaaaaaaagaagcaaggaatattccaccgaaatctgtatgaagtatctggaaaaggtaggtatggctccttatgtaaaagcaaaaccacaccagttatccggtggtatgaaacagagagtggcgatcgccagggcacttgcaatggaaccggaagtattgctttttgatgaaccgacttccgcattggatccggaaatggtcggagaagttttatcggttatgaaacagcttgccaatgaaggacttacgatggtgatcgtaacgcatgagatggcgtttgcaagagatgtatccacaagaaccattttcatggataaaggatatattgtggaggatgcaccgccacaggagttatttaataacccgaaggaagcgagaaccagagagtttttaagcaggtttatgcagggttaaggttcgtaaaagacaaattgtatttgttttttaatcatagaatgaggaggacaatattatgagaagaaaattaacagcagcacttttgacagcagcaatggcaatttcattaacagcctgtggcggatcaggtgacacagcttcggcaggggcatccacaggagagacagcaagtgtgacagaggcgggcggaacaacaaccgcttccggaaaagaagttctccgggttgcaatgtcagcagattatgcaccgtttgactggctgcaggaggatgactccaatggagcagtgatgacatcgaatggttcctatatgaatggttatgatgttcttgtcgcaaaatacatagcagaaaaactggatatggatcttgaaatcacacagattgactgggatggtctgatcctttccatccagtccggaaaagttgactgtgcgatcgccggaatgtccatcacaagcgagagatcccagtcggtagatttctcggatccgtattacaatgcaaatattgttgcggttgttgcggctgacggaccttatgcagatgcagtaaatgttacagattttgagggtgcaacacttacctctacactgaacacagtatggtatgatgtattagaccagatcacggattatgcgacaaaggatgcagcgcttgatacatttgcatctatggttgcagcagtccatgcaggaaaaattgatggatttacctgtgatatgccttctgcaaaatctattttagtaagcaatccggatttaaagatcatcgattttgagggcggtaccggatttgaggtcagcaacgaagagacagaccttggtatcccttgccagaaaggaaacacagaattagtagataagatcaatgaagtgctcgccggactctcaaaggaggatagagatgccatgatggatcaggcagtagcatcccagccggtaagcaactaatatggaacagacagcagtcgaaaaaaaattcggaaaatatgtcatggcttccatgatcaccatgtttctccaaagcgcctactccatgattgacggtttatttgtcagcaatctgataggtgacacggcattatccgcagtcaatgttgcgtggccggtcattgcagtgataactgcgatcggcaccggcgttggatgcggcggagccgtaattatgtcaaccaaacagggagagggaaagaacgaagagtcgaacattgtacgggcaaatgtcattcttgcattattggcatcaagtattgtggttacgattctttttcttgttttactgacacccttactgaaactgatgggcgcggaaggcgaacttttaaggttatcgcagatttatggaagggtaatgctcacaggcggcgtgcttcagatcttatcctgtggactgacacctcttctcaggaatgacaaccgggcggtcagtgccatgatgatcatggtgggtggtttatttgctaaccttggtcttgattttgtttttatgtatgtttttcatatgggaattggcggtgcagcaggcgcttcactgtgtgcgcagttgtttacgactgtgtgctgcctgatgattctttgcacaaagaaaacagatccaatccgtctttcacagtttatgataaggaaggaatactggaaaaaaatttttaagacagcagtttcaccgtttggaatatcgctgaccccttctttattgattttatatcacaacgttgcgtgtttaaaatttggcggcgatcttgcggtaaatgcatatgcactcatcagttccaccgtcggctcgtaccgtgtgcttctgattggtgtcgcagaggggattcagccacttgcaagttatgcctatggcgcacatgattttcatgcgatccggaaaataagaaataaggcgatcatcacagcaatgagtgtgagtttcttcttatttatatttaccattgcaacagcccggttttacccagccatttatggatatgagggggaagcggcagaacttggttatcatgcggtcaaggtgacggcagcacagcttatttttacaggacttgtccgtgtgaccaattcctttttctattcggttggaaaagataaatactcgctgtttatgatttactttgatccactgattatgacgccgcttacgatcatgatcctcccacggatttttggactggatggtatctggatcacagcagttgtgacgcagtttattttaaacattgtggcatttggaatgtttgcaagtcatgaaagacagatgaagaggatggaagcagagaaagcatttgcaggaaaatgagaaggataagagaaatcgtacagtagacaggtacatgaaaaagaacgtaacgaagatggccggtacaccatcaaagttacgttctttttcctttccctaataaatcgcgttcgtacaagtactacgcactacatgaaataaaatgtttgttaatgtttatataataggaagaaactcctatgtaataaaaccggaactatgaaaaaatgcagattagaaatctgtaagatcagcttttctcttctctaagaaggcacccattccttcttttttatcatgagtatcatttacaacaccgaagaggtttgcttccatctcaacagcattcttgatatccatatcgtaaccattgttgatcgctgcttttgcaactgatacagcgtagcttcctttggagatgatctttgctgccatagcttttgcagtttccattaattcttcttttgcaacaactttgttcactaaaccgatgcggtaagcttcgtttgcatcgatgttatcgcatgtgaagatcatttctttggcacgtcccataccaactaagcgggcaagtctctgtgtaccgccgaatccaggaatgattccaagtccacattccggctgaccgaagattgcgttgtcagatgcaatacggatatcacatgccatggcaatctcacatccaccgccaagtgcgaaaccgttaacggctgcgattgttacctgacgcatattcattaatttgaagaatggaacagaagctctgataccgaatgctcttgcctccggagctgtaaagttcaccatctcggcaatatcagcacctgcaacaaaagatttgaatgcgttgtctttcttgtcaggaccaccggttaagatcacaactttgatatcgtctcttccctcgatctctgttaaagctgtgtttaactcgtctaatgtctcactgtttaatgcatttaatgctgctggtcttgagatggtaagaacggcgatctcgttctccacatctaattttaaattgttgaattcgctcacgataataccctcctgaatagattgataaaaaattaacaatacatgttatatctagagtacttcttttgagaggatttgtcaatatgaacgtcgataaactttttctaaaatctgtaaaaaatggaaattcgctccgtttacatccgggggattccttattataatgggaatatgagtgaaacatactttatgttatgaggactttgacaattgcaaaacttatataatttttttgaaattgttcaaaagtaacaaaattttcgaaaacccgctttcgctacgtgtcgctggtagcggtactaagaagtcagttacaacttacgttgtatctgccttctaagaaccgaccgctccccagtgttttctcaagcttttgttactttttcacaattcaatttacattttgtgagttttgcaattgaatttacattacatatgatgttgataataattgatatttgaaggtaaagaggaataaaacatgatcacagattttaatttacagattttaatagagccgttgttaaattggtttgcggggcatgcccgtgtgcttccgtggagggaagaaccgacaccgtaccgggtgtgggtgtcggagattatgttgcagcagacgcgagtggaagcggtaaaaccttattttgagcggtttacgaagcgactgccggatgtggaggctttggcggaatgcccggaggatgagctgctaaaactctgggagggattaggctattacaaccgcgtgcggaatatgcagaaggcagccattcaggtgatggaagcatatggtggaaaacttccggcagattatgaggaattgttgaaactaaagggaatcggtagttacaccgcaggggcaatcgcctccattgcataccagattccggtgccggctgtggatgggaatgtattccgcatcctgacgagagtggctgcggacgataccgatattatgaagccgtcttttcgcacccttctggaaaaagagctgcgggaagtcatgcagggaatggagatgccgggggcgtttaaccaggcactgatggaacttggtgcgaccgtgtgtgtgccgaacggtgcgccgttatgtgaacaatgtccgtggaacagtctctgtctggcaaggaaagagggcaggatcgcagaacttccggtcaggacgaaagcgaaagcgagacgtatcgaaaagaggacggtgcttgtcatccgggataatgataaagtggcaatccggaaacgaccggaaaaaggacttctggcaggactctatgaactgccgaatgttgttgggcgatactcgcaggatgagattgttcatctggtaaaagatatgcatctttctccgatccgggtgcagaagttagagaatgcaaaacatattttttctcatatcgaatggcagatggaagggtatgcaattttagtggaagaagcaggatttgacgccgaggcagagaaaatggcagaaaatcatctcatttttgtagatgcagaaaaatctcaggaaaattatgcaattccgtctgcgtttgctgcttatgcaaaatatatggggatcagacttggaaatgaaaaatttctggtgacggattagaaagcatggaagtattacaatttccgggataaaaaagagggagccggtgcaatgcaccggctattcatatgaaaaagattgtgtatggaaagtgaaatgcttcactattttctgggaggaaccttgcttactggttaagcaaggcaacctgatctactcaggtatgaaaaaaagttctatgaaaaattttcttgttggcttaacttatgcttagagtataaagttgaattgtgtctatcgtatgatggctttgtgagaaatttgtaaataaaatatgaacaaaatgttcaaaattcaggctgtaataaataattaagaaaaaataaattggcttgtcataataaaatatgtataataggaaagtactacaaccgtttcgcagtccggatacaggattgcagacgatcagtaaataatttgggaaaatgttgaaattataataaggaaagtcagaggtaataaaagatgtacgattgcatcgtgataggagccggaattgccggagcagcctgtgccagaaaactggcagaggaagccggaaagaaagttcttgtgattgagagacgaagccatgttggaggaaactgctatgatgttttggatgaatatggcattttaatccatgagtatggtccacatattttccatacaggtctggaagaagtttatgaatatctttccagatttacggaatggtatcctttcggacatgaagtggtagcaaaagtgggggacaagctgatcccggttccatttaacttaaatacgctgcacatggtctatgataaggaaaaagcagatcttctggagaaaaaactgatcgaagcttacggtgagggaagccgtgtgccgatcatgaaacttcgtgagaatgatgatccggatatccgtgagatcgcacagtatgtctatgagaatgtatttttgaaatataccatgaaacagtggggacagaagccggaagagatcagtccggaagtgacaggaagagtgccggtgctgatctcttatgataaccgttattttcaggacaaatatcagggtgtgccaaaggatggcttcacaccgatgtttgagcatatgttagatcatgagaacatagaagttgttctggatacagactgcagggatgtcttaaagtttacagggaatgagatcctttttgagggaaaaccatttgagggagatgtcatttacacaggagcgctggatgagctttttaattgtaaattcggcagactgccatatcgttcgctggatttccattttgagcattatgatgaggagtcttatcagggacacagcgtggtaaactacacggtaagcgaagattacacccgcattacggagtttaaatttctgacgggacagaaaaatacagatggaactacaattgtaaaagaatatccgtttgcatatacgggcgcagcgggcgagattccctactatgcgattttaaatgagaaaaatcaggcgctttacgagaaatacagggcgcttacagcaggacttccgaagttccatttattaggcaggcttgcagaatacaaatattacaatattgatgccatgacgaaaaaagccatggaactggcagatgccattatgaatcagtaggaaaggttatcattatgaagttacttacatttgcaattccatcttataattcgcaggattatatggaacactgcatcctgtctctgcttccgggtggggatgatgttgagattttgatcgtggatgacgggtcaaaggaccgcaccgcagagatcgcagacgagtacgagagaaaatatccgggaatcgtgcgtgccatccatcaggaaaacggaggacacggagaggccgtgaatgccggaatccgcaatgccacaggacttttcttcaaggttgtggacagtgacgactgggtggattacgaagcctatatgaagattttaaaaaaattgcgtgaacttgctggtggagataccgtgctggatatgtttattgcaaattatgtttatgaaaaagagggtgtacggcacaaaaaaatcatgcgctattcttccctgccgcaggataagatttttacatggaatgaggcaggaagattccataagggacagtacattctgatgcattctgtcatttaccgtacacagcttctgcgggaatgtggactggaactgccaaaacatactttttatgtggataacatttatgtgtacaagccattgccaagcgtaaagcatatgtactatatggatgttgatttttaccgttacttcattggacgtgatgatcagtccgtcaatgaaaaagtgatgatcggtcgtattgaccagcagatcaaggtaaataagattatgatcgatgagtttgatctctggaagatcccgaatccaaaactgcgccactatatgttcaattatctcgagatcatcacagtgatctcaacgatcatgctgatccgctccggcacagaggagaatcttgagaaaaaacgcgagttatggaaatatatcaaagaccatgatatccgtctgttccaccatttgagaaacggtattatgggaaatgcgatgaaccttccgggaagaggcggaagaaagatttcagttgcagcttacaaactttcacagaaaattgttggatttaactaaggatatggtgatcatgtatgtacgttagacggtcaaatatggaagatataccggcaatgatggatttatatgcacaggcaagggtttttatgcgtgaaaatggaaatctaaaccagtgggatgaaagttatccatcgagagaactgctggaaaaggatattgcctttggaaacagctacattgtagaagatgatgagaagaaccttgcagcaacatttgcctttataaaaggtgaggacccgacttattatgggatcgaaaatggggcatggctgaatcatgaaccatatggaaccattcacagacttgcgggaaatacttcttatcatggaattgccagtggatgtattagctggtgtaagagccagattggaaatctgagagcagacacccatgaggataataaaatcatgcagcatttgttggaaaagaatggattcgtgcgatgtggaatcattcatcttgcaaatggtgcgccaagaattgcttatcagtttgccggagacagtacaaactaccggggcagcaatgaacagtcgcagcagaattataatcagccaaaccgcagtaatcagccgatgcaaaatcagaactggagtgtgagagaagtttcttccggtgggcgtggattcggaattgcgtccatggtacttggcattatcgcactggtcttattcttttccttcgtgaatattccacttgcgatcctcgccattatctttggtatcatccagttgacgagaaaggcaccaaaagggatggcaatctccgggatcgtcatgagtacaatctcattatttctgttagtgattttctgggcttgtatgtttgtgtcagatgccagaacagaaagcacggatagcagcacttactattatgaaggttcagaaaatgatgatgcttccggtgattattatgatggcttatatgagggctatcagcagggatacaaagatggctattatgatggctactatggctacacaccggatgaagaattctatggtcatacaccggatgacagcttctatggttatctgccgaatgatgattcttataattttcatgggaagaacggcatatattattaacaaagaaatgacagccggggaatccgtttgagacagaaaagcaatggaaagcaacaattcgttataaaaagagcagcaggatttctgctgcttatttttgcgtttacagggatcattggtatttgcgtggaaaaaaaggacaataggataagagcagacagtgggatggagacagagagaatggcagaagagaacacgaaagcagcatcaggaaaaatcaaagaagaggaagttaagaaagtggctttgacatttgacgatggaccaaatccggatcatacggagacacttttggaaggtttgaaagagcggaatgtgaaggcaactttttttcttctgggtgcggagtgtgaaaaatatccagagatcgtgaagaaaatccatgcagacggacatctcatcggcgttcattcttatgaacatgtgaatctttccaatctcacggatcaggcggcgatggaacaggtggacaaaacagaccagattatttttggactgaccggagaacatgcgcagtatatcagaccgccttacggctgctggaaatgcaatctcgattatgagacaaaaatgatcgaggtgctgtgggacgtcgatccgctcgactggaagacagataattccagcgtcattgcaaagcgtgtcatggataaagtgcaggaaaatgatatcattctgctgcatgatgcctcagaatcatcggtaaatgcagcacttctgattattgatgaattgcagggagagggatattcgtttgtgacggtcgaggaactgatattggaataatttacaaatgtaaaatgctatgataacagaaacagaggtaacacattgtatattgtgttacctctgtttcttgctttatatatcggacagagtttccattacttaacccctttttttaaaaaaatttattcaagtatgtgaggagaaaaaatatgaacacagctcagccaatccgctcagaacaggaactgaaagattttatgaacttttatgaacaggtacagtatcatccgagaaatcaactgctgcttacgatggggctgaataccgcattaaggatttcggatcttctttctttacagtggaagcaggtatatgacttagaaaaccggagcgtaagagaacatctgcttcttgtggaggcaaagaccggaaaagcatcgaatatttatctgaatgaaaaaataactgtccagctgcaaaaatactatcagtttttagcgtctggacgcagttttgagattagcggggatgcgtatcttttctgtggaaaagacgcagatccaatctcaagggtacaggcttaccggattatccgcaaggcggcagaaaacagcggtctaagcggcgtgataagcccgcattccttgcggaaaacatttggatattatgcgtggaagcagggagttccaccggtacttctcatggagatttatcatcattcctcttttgacatcaccaaacgttatcttggaatcgagcaggatgacagggatgaggttttccgcaaaatctgtttataaaggagaggattttccttcttataaaatatctgaataatatgcattgtgatcaatgtggctccatgatttcggaacgcaaaacagaggtaacacaatatacaatgtgttaccagtatctgaaacggatggagtaccgtttttaatatacgcagtatttatggaaaaatacaaagccacatggaggttacaatgcttaaattatctttaaaaccgggagaatacattgatataggagaaaacatccgtgtcgttttttccggtggttctgcaaataacattcatcttcttgtagacgcaccacgcgaatacaacattgtgcgcagtaattccatgaagcagaaggacaaaaaagaatactatcgtgagcagacaatctcggaggaggcaaagcgcgagattgcaggaatcttaatgcgtgagaagcacgcagcttctgagataacggacagaccggttgcaaaaaaagccatttacacagtcagccacagacggtaataatgccatgctaacctaggggcgtggtttattatacaggcactttgtgccaaaatcctgattttattcagggaaaagggaatggaatcccgaaaataaaaattattttagcggcagaaaggccgcaacacacggaggtaaaaaattatggtagtacaacacaacatgcaggcaatgaacgccaacagaatgttaaacgtaacaacaggacagcaggcaaaatccacagagaagttatcttcaggttacaagatcaaccgtgcagcagatgatgcagcaggattaacaatttctgagaaaatgagaaaacagatccgtggtcttgatcaggcttccacaaacgctcaggatggtgtttcttctgtacagacagcagagggcgctttaacagaagttcactctatgttacagagaatgaacgagttagcagttcaggcagctaacggaacaaatgctgaatctgaccgtcaggcaatccaggatgagatcgatcagttaacaactgagatcgaccgtgttgctgagacaacaaaattcaacgagatctatctgttaaagggagattccgagggtggtacaaaaacagaaaaacttgctgctcatgatgcaggattagcaggaacattagttgataatggcgatacagctacctttactgcaaaggctttaaaacatggcgaagagattaatattgctggaaaatcttatacggtagatggtgtaacaaaacctactaccaatagtattgcacagggtacaacgggtacagctggtgttaaaggcacatatactttcgcattagcaggcatgcaggcagatcttaatggtaaagctacatttactattgacggaaaagactatacgattgatgtggcaaaagatgatgatgcaacagctattggaactaagcttgcaacagcacttgatggcaagattgatgatggattaggaactaaatatgctgttacaaacaatgcaggtactcttacgtttgaggcaggtaaagtgggagcaaataataaagcaatcacaggtgcatacaagccattagaaaacggaacaacggtaacagatatttataataagatgaaagatgagttagcaacagccagcagcattggaacagatacagctgcaactgttacaaacaataatgacggaactttcactatcacaaaaggttctgtttccgttgctgagagcttatctttcaatcttcatgtaggagcagatgcagatttaacaaacaagatcaatgtgaatatcgaaacaatgaattctgcatatcttggaatcaaaaacttaaatgtaactgataaaacaggtacagcagctacctatgcagtagacgcaatcgcagacgcagtagcaaaagtttcttcccagcgttccgctctcggtgctgttcagaacagattagagcatacgatcgacaacttagataacgttgttgagaacacaacatccgctgaatcccgtatccgtgatacagatatggctgaagagatggttaactacagcaagaacaacattcttgcacaggcaggtcagtctatgcttgcacaggcaaaccagtctacacagggtgttctttctctgttacagtaattacagataccataagacaagcaacgacaaaaagtctgaccgcatcagcggtcaggcttttttgtcgttggtgcgcccggcgtcgcacgtttctaagtatgaaggacatgccgtcagtctgtgcacgtcaattattgaaaccgccgtgtaccgaacggtacgcacggtggtgtgacaggacggcggttggtcacgtctcctactcgattattcggaatgaacagtaatatatttttgttttcgactgtttggcttatctggaatagtcattttaagctggccacttgccagtagaggattcaaatattttcttgtaaaataagtgagatttcgataaccaataaacgagcaaatttcgtgtttgcttttttctgttatacaaaaatccaagactgcgtgtaggatgtcctgtgatttatcttgatcactaacttggtcacaatcttggtcactgactaagtctttctgactaagatggtaattcacatttttcaaaataactctgaaatctgttgctgtcgagaagaattcaggtttatatatttctgaatatcctggtaatttttcagtttcactgacgatttttcgtagaccacttccacggcgttccatgtatttcatgcggtggaacaggtcagcaatcacagggtttcgtcgcatcgaacgaatactgtaaatatcgtattcctgaattgagccgccgccaaacataccgcctggagatgtgatttccacccgatcatcaaacatatcaatgtggacttcgctgccaagcacaatataatcacgatggatgagagcgttgacaagagcttctgttacagctcgttcagcataatccggcttgtctacccgatactgagcttctttgacaaaacggactttggaattattgcgaataaattcactgccgcttttcagtaaataaatcaaattcccctcgtattccttatcatccagcgcatcatcaaagatagagcctttttccaagccattccaccgggtacagaacatacgggagttataaactgtgtgctgatcggtcatgagctttccggcattggtcaggaatccatttttgtcagccaaaccgaaggagacataatcggatggctcaaagcggagaccaatccgttccagataggttgcttccagaagtgtaaagctgtaatccttttttaccgcgtctgttgttagggtatcaaaggactgattggttccctttaagatcaattcatttacaatgtaatccggggcaattacgctttcatttccaacacggatatatgcttccatcacgccgtctgccttgtaataataaggggtgctgcggccgggagaaacctccagagctaatagatttttatcatcttcctgtaatggttttaagataaactgaggtaatggtgtgattcgttctttgattaagcggctgatcgcctcagcatccttttgaacatcggacaagccgataggtttccggtcatcagagattccgaaaaacagagttccgccgattccattagaaaaggaactgacactttttaaccagcttttgggtttctttatttcaagtgcaactttgaaatcacattcggttgcttcggcaattagctgttctatcataaaatccctcctttgaggtattggtagtttctttatattatacccataaggagagtttatttcaacgataggcacaaagagttcagagaaaatattttgagaggatggcggtagacaccgcctcctgctcgttgggtatccccacataaaacaggttgcttttgcagggctatgtatgcaataatatcattaaattcagaaacatgacacaggtcaaaatgacaatataggtaattgcaaaacttatagaaaacataatttaatcgtggaaaataagataaaatgaaatatccacttgtcaaacagggcaaattcatgtaatgtaataattgcgatgaattttcacgaataaaatccgtcatatttttggaataaaatactaaaaattgaatttatgatctcaaatattgcaagttttgaaattagaatattcaatatggtcaagtgtacgcactacacggacaagaagaaaggttttttgtatggatttatttgattatatgagagaacagaacagggaaaaggaatcgccgttagcttccagacttcgtccagcgacgctggatgagatggtagggcagcagcatatcatcggaaaagacaagctgctttaccgtgcgatcaaggctgacaagttgagttccattattttatatggaccgccgggaaccggaaaaacgacactggcaaaggtcattgccaataccacaagcgctgagttccttcagatcaatgcaacttccgctgggaaaaaagacatggaggatgtcattgcgcaggcgaagaacaatcagggcatgtacggcaaaaagacgatcctgtttatcgatgagatccaccggttcaacaagggacagcaggactatctccttccgtttgtggaggacggaaccgtgatcttaattggtgcaacgaccgagaatccatattttgaggtgaatggagcacttttgtcccgttccattatttttgagctgaagaatctgtccacggaagatattaagacgctgattctccgggcagtaaatgataaagaaaaaggaatgggcgcttacgatgcagttattgacgaagaggcactggattttcttgcggacgtggcaaacggagacgcaagagcagcactcacagcgatcgaacttggtattttgacaacggagcggagtgatgatggaaaaatccatatcacactcgaggttgccagtgaatgtatccagaagcgtgtggtgcgttatgataagaccggagacaatcactatgatacgatctctgcttttatcaaaagtatgcgcggctctgacccggatgcagcagtttattatcttgccagaatgctttacgcgggggaagatattaagtttatcgcaagaagaattatgatctgcgcggcagaggatgtgagcaatgccgatccgatggcactcgttgtcgcaacatcagcagcacaggcagttgagcgtatcggtatgccggaggcacagattattttgtcgcaggcggtcacgtatgtggcaagcgcgccaaagagcaactcggcagtcaatgcgatcttcgatgcgatggaagcagtaaaaaatacgaaaacagcgccgatcccggttcatttacaggatgcacactataagtcatccggaaaactggggcatggtgttggatataaatatgcacatgattatccgaatcattatgtggagcagcaatatctgccggacggactgacagaccggaagttctacgttccgggtgagaacggctacgagaagaagatccgtgaatatttcaaaaagatcaagggtgagccagaagaggagtaagagaacattccgggcatgagatgatctctgtttcacaggctgatgagcagagcacatttttccggtattggatctttacatatattaaaaagcaggaggaattagagatgaagtcctacgaggaaatgacaaaagaagagttattgaaagagaaggaaggattggaagcggaatacaaaaaattccagcagagaggcttaaaacttgatatgtccagaggtaagccatcccaggaacagttagacctttcgatgggaatgatggatgtactgacttccggtgttgatctgacctgtgatgatggtacagactgcagaaactatggtgtgctggacggtatcagtgaagcaaaacagcttatcggtgatatgatcgagtgtaatccggacaatatcatcatttatggtaactcaagccttaacattatgtatgacaccatctcccgttccatgacgcacggtgtaatgggaaatacgccatggtgtaaattagataaagtaaaatttttgtgcccggtaccgggatatgacagacattttgcaatcacagaatatttcggcattgagatgatcaacgtaccgatgcttccgaccggaccggatatggatatggtggaagaccttgtgagcaaagatgaggcgatcaaaggtatctggtgtgtgccaaaatattccaatccacagggaatcacttattcggatgagacggtccgccgttttgcaagattaaaaccggcagcaaaagatttccgtatttactgggataacgcatactgcgtgcatcatttatatgatattaatcaggatcatctgatcgagatcttaaaagaatgcaagagagcaggaaacccggatatggtttacaaattctgttctacaagcaagatcacattccctggttccggtgtggcagcgatcgcaacttctgccaacaacttagaggatatcaagaaacagttgaagatccagaccattggtcatgataaggtaaaccagctgcgccatgtccgtttcttcaaagatatccacggaatcacagagcatatgcgcaaacacgcagattctctccgtccaaaatttgaaatgatcctggatacatttgaaagagagctaaaaggactcggagccggaagctggtacagcccgaagggtggatacttcatcacatatgagacactggatggatgtgcaaaaaatgttgtggcaaaagcaaaaaaagcaggggttgtgatgactccggcgggtgcgcctttcccatatggaaaagatccgcatgattctgtcatccgtatctcaccatcctatccaagcctggaagatcttacgactgcgatcgacatctttgttgtctgtgtcaagctcgcaagcattgagaagcttttaggagaataatagtaagtttttaaccgctgaaaagcaaaagaaaaagacctgtgtgtacaatgtcatgatgttcgcatgacataggtacacgcaggtcttttttatgaattatgcctcagtggaagcatcctctgttccgtttttccatttgttgaatttctcgacaactgcgtcgtaggttctctgggaaatatccggaagtttatctccccatgctttggttgcctgttcgaaacctttcttgaaagcttctaacatagcgtctgccttgtcaggatcatcaccggataaagcttttgcaaaatcaagaatacggtcggaagtctgctctacaccccagtaaccgtcgtctgcgatatctgcctgtgcctgtgctttcacatcggctgatacggtaaaatcaccttttgcaaggaatttccacatatcatctgcggtgccgatcgcaacaccctgcttggtcatcatctgctcaacgatgctgcggagctgtgcagtgcgctgctctgcgtcagcttttaactttgcaacgatcgctgcgttgtcggtcttgcttgttgttttattggaagccttgtctgtcctggagtcagaactcttctcataaatgacaccggaagctgtcttggaagaagctgcctttttcgttgtctcggatgtcttttctgctgattttgttgttgtctgtgtagatgctgctgcggcagcagtcacagtgttaatggaattgattgccatatgatcctccttgtctggcgaagctggatgcatttgtttttacagaaaacaaaatgttcagccacctgaatgaatagttattaaccttccatggttctgttaattatatcggactggcaaagaaaaaagtttagtgccgattgaccttttggacataaaatgataagatactaattgtatacaaaaaacacaaaaaaaacaagttttattttaggtacaatcaatgcgtgttagcgacgattttggtaaggagaaactaaccgatgaaggatatttcagtaaaggcgctggctaagatcaatcttgggctggatgtggtacgaaaaagagaggatggttatcatgaggtccgcatggtgatgcagaccattcatttgtttgacaggctggagatctcgaagaatacttccggtgagatcacgatggaaacgaatctttcttttttgccgacgaatgagaacaatcttgtctataaagcggcaaagcttttgcaggatgagtttgcgataaaagatggcgtgcatgtatggctgcacaagtacattccggtagctgccgggatggcagggggaagcacggacgcagcggcagtgttatatggtatgaaccagatttttgatctgggactgacaagggaagaactgatggagcgcggtgtgaagatcggtgcagacgttccgtactgcattatgcgtggaacggctttggcagagggcataggagagaagctttcgaagcttccgccgatggtgaaatgtcctgttttgatcgcaaaaccgcagatcagtgtttctactaagttcgtctatgacaatctgaagttaggctctgatatggtacacccggatattgaccggcttgtggcagatatcagagagaaagatttatataaaattgcagcagatatgggaaatgtcttagagacagtgacaatcccggcttatcctgtgatcgcagacatcaaagatcacatgatggagcatggcgctgtgaatgctatgatgagtggcagtggtccgacggttttcggtctttttgacaaggaagcgacggcagtagaggcatacgaggcgatgaaagcctccggtcttgcaaaacaggtatatttaacgagtatttataataacgcgcgtaagtagaaaggcatggtatcaaagatgacagaagatttaacattgaatatggatgcgtatcttccgctgagagatgttgtgtttaacacgttaagagaggctattttaaaaggggaattaaaaccgggcgagcggctgatggagctgcagcttgcggcaaaacttggtgtcagccgtacaccgatccgtgaggcgatccgtatgcttgagcaggagggacttgccgttacgattccaagaaaaggcgcggaagttgccaaaatgacggagaaagatatggaggatgtccttcagatccgtgaagcgttagacgagcttgcggcaaaaattgcatgtgagcagatttctgaggaacagttagaagagctggttgcgaccatgcatgagtttgaggaatccaccaagacagataatgtgaaaaaaatcgcagaggcggatgtaaagtttcacgatattatttaccagtcaaccggtaacccaaagcttgtgaatatgttaaataacctccgtgagcagatgtaccgttatcgtgtagaatatctgaaggatgagaataattacccgacgctcatgaaggaacacaaagacatcgtggagggattagtccgcaaaaataaaatgcaggtgacagagacaatgcaccagcatgtaaagaatcaggcagtcgcagttaaggctatgatccaggagcaggaataagaagtaactgcccggaggacaggaaaactgcataaaaaatggaaaaccgtacagactagaaagaggataagcattttgcttatcctctttcgtattagggggaattaatagaaaggaaacaagctggaaatgtcggaaaatcagaaatgtccggtgtcgacggatttaacgcaaaatatagaggaaatggaattttattttcatgactgtgcggacattaaaaagaagcagatgaagcttggcaggaatcaggataccgcctgttatctgacctttattgaagtgtccgtggacatgggaacgtccgcactcggagagactttaaaatacttaaatggactgacaagggatgagatcctttgtacactgcaggaaaatgcgcttggaatttcggatgcaacatatttttcgaccattgaggaggctgtgagcggcctgctcaccggggaggcaatcctttttgtggacggttttgaccgggcagtaaaaataccggatgacggttatccgaatatggggatcacagaggtggattccgaaaaagtaatccgcggttctaacgaaggtttctgcgattctgtgaagcagaatgcggcgctgatccggaaaaggatccgctcgccccgtgtgaaagtgaggggactgaaggccgggatcagatcgaacacgaacgtctaccttgtgtatgtggaagaccttgcaaacccgggacttgtaaaagaaattgaaaagaggctgcaggatttcacgattgatgggatattagacagcggaatgttagaacagctggcagagaaaaaatggtattcgccatttccacagtttcagacaacgcagcgtcccgaccgggcggccatggcagtattagagggcagagtgatcgtgatgtgcgataattcgccgatcggtctgatactgccgacggactacaattcatttatccgcaccagtgacgattattacagccgttttgagattgcaactttcgggcggatcctgcggtatctcgcatccttttttgcaatgacgctgccgggattttatcttgcagtgactaattttcatacacagatactcccgaccacactacttttgtcgtttgcagaggcgaggcagggtgtcccatttccggcagtcgtggaagtgcttatcatggaattatcgtttgaacttttgcgggaggcgggcgtgcggcttcccggtgcgatgggaaataccatcgggatcgtgggtggcctgattatcggacaggcggcagtcgaggcaaatctggtcagcccgatcgtggtgatcgtcatctcttttactgcgctatgttcttttgcaataccgaacgaagaatttgccacagccttccgtatcctgaaattcttttttattgcggtctgtgcgtggcttggctactttggcatgctcctcggactgcttgcggtactcacacatctgtcgcatctgacaagctttggtattccgtatctcatgccgtttgtgggagcagatttgaacaattacgaggatgagcgggattttatctggcggcagcctttccggaaactgcgcaaacgtccgatttatgcaaatccgaaagagcggacaaagctgacgttttcaaagaagagataggttgagaaaagtttttatcttaagataaatggaaatctgatgaaaaaatgcgcagatgttagaagagatagggggaagtatgttctcagaaaacaatcaaatttcaggcagacaggtgttccgccttctgacgtatgactttcttggaatggggacgctgctactgccgacaatgcttgcagatacggcagggcgcgacgggattttttgcattctggcggggattttgtccacatttttgtacttgaaattattgagatatctgttgaaaggcatgaaaacaagttatcccgactttttgaagcagaagtgtggaaaagtatgcggttatgtgctctggggcggatattttctgtattttatccttatggcttcgtacacggcgtatctgttttccacgctgatgttaaatggtcttgtggaaaacgtcagcttttatctggtgctgatgttgatattactgctcgcattttatggaatggcaggtgggatcgagggcagggcgagagtgtacgagatgctgttctggtttctgatgataccgctgtttctgatgttatttgcggcgtgcagggaggtgaagccagcctactggagcccggtttttgtggcggatggaaaagaaatgttaaacggaagttattatgtatttttctgctattctatggtgtcaatcgtactttttttgaaagaatacgtgtcggatgacaaaaaacatatcagcgcggcggaaaaagcggtctggttttccggcggagtatttgctgtgctgtatctgatcctgatcgggctgtttggtgcggaggcactggctcagatgaaatttccggcggtcacgatgatgagcagggtgcagattaccgggggatttctgaaaaggacggatgcttttatgttcagcatctggttctttacgctgtatgcaatgctgaacagcatggttttttacagtggaaatctggctgcaaaagtaatccgtgactgcggcggttatctggaagggaaaaaaagaatgctgacgtatctcattctgcttcttctggtgtatggcgtgacagtgctgttttacagaaatcagcagtttttggactgcgtgacattcctgctgtggaagattggaacaccttttgtcgttggcgtgccgatactgttgtgtctgaccggagagagaaaaaaacataagaaaaaagtgcgtgtgctggtgctggtatgttttttgtttgggtgtcttttcttacaggggtgcaatgtcgcagaacttgaggataaggcattcccggttcttttgaatatcagagatcaggacgatttccaaaatgtatggctgaatcatgagtatgcaggaaacaaagaggtggattacaaccatttgaaagtggtgctcattgagaggtcttttctggaaaaagaggcggaagtggaagatatgctatccatgctggagcaggaaaaagaggttccgtggaacgcttatgtgatgacgacggaaagctgtgaccgtctggcgcagaccgaagggaaacttgacacgctgcttggaaattatctggaagaactgctggaaaatacatcgggcattgatcagaaagcgtacccgacgcttggcatgctctatgaggagcgtgctaatcacttagagacactgtatattccttttgtcgatatagagggggagcagtccggggcagtggaggatgataccgagaaaccgcagattacagcctatgaagtctggaaacgtggaagggcggcggggcttgtcgatacggataccgcgcgtgcagcattcttcacgcagaactttgcggatgattacaccttacaacttgcaccggaactttatgtgaaagtggatgcagcttcctgtcgagtcaaagaaacagaaaaaatcggtgtcggaggtttgacagagcagattgtcgcagtgactgtgacaggagaaggcgaaatcttaagcggcacagtttccgcaagtgaaaaagagcagcttctcaacacccggatggaggactatctgaatgcgatcgctgcacatgcacttgagaaagaaatcgatatcactaacagttaccggaatctcggcgccgataaccgcacatggtattttaagtatcaaaacactcctgccgcttatgagaaagacatcaaaatccaatatctggtaaaaataaactggaaatcggaataaatgcaaagttttcgggaatcattgaggatagaaggtcgatgagcgaaactcgaatttaggttatgaagattgcgaaaaatgaacaaaaatattcaagacacgctcccgctatgtgtcactcgcagcggtactatatttctgtttatttttcgcaatataacatattctatgagcgagtttcgcaagcaacgacacagcctgataaatatgaatattatctacatttatctgatttttggcaagtgaaaaggagatttgaattatggcaagaaaatggattggatacataggagttggaagtctgatgtgcgctgcattgggatgcggtattttgtatacaagacaggccagactgcagcaggcgatttcggacaaagtgctgcggtttcatgtgctggcgaacagcgacagcgaggcagaccagaacctaaaactagcagtgcgtgatgcggtgggaagttttatgcaggaaaaactgacagctgtggaaaatctggaagaatgtgagatggttgtgcgccagagcctcggtgaaattgaggaagctgcggcagagacaatcgcagaaaacggttatgactatgatgtgacagcggagctggaacacacttcgtttccggtaaaaaactatggaagctacacctttccggcgggagattacgaggcactccgcattgtgatcggagaaggaaacggacataactggtggtgtgtgatgtatcctaacatgtgtttttcagacagtatgtatgaggtggtcgataaggaagcaggagaaaagctgcgtgaagtactgaccacagaagagtatgagaaggtgctggcagaaggagactatcaggttagaatgaaatatttttcgtggctgaatccgtatctggagaagctggctgaaaactaaaataaagcagcatacttataagaaagcaatgtttcaaaaagcttacgcttgctaaattataagaaacacgctaatatatggcttgaaaagataatgacgagaaacagaaaagaggtttacataaatgacaaaagatgtacttgtgaaaatcagcggattacagtttgcagaagatcaggataatggtccggtggagattatcacaaccggaaactactataagaaaaatggaaagcactatattttgtatgatgaagtgcaggaaggctttgacggcgtgacgaaaagcgttatcaaagtgaatgatgattttctggatgtcacgaaaaaaggtgtcaccaacgtacatatgatgtttgagaaaaacaagaaaaatatgtcttactacaacacaccattcggaaatcttttggtgggaatcaatgcaacggatgtcaaagtgaatgagacagaagataatattgacatcaaagtcgattataagctggaagtgaattatgaacatctggcagagtgcagcatttccatgaatatcatgtcgaaagatacgaaggattttaggatataaggagtgcaagtgagaagaatgcatttatgcattcggcgaacgatgaatgttaatcatgtgccgtttttgcacatgatatgataatcgtgaagttgaggtagtgtattatgaaaaattgtaaaatggcattcacaatcggtttggtgtttgcagtaatgatgttggttgcagcctgcacagacagcaacaaatcagacaatcatatatttgatcatgaaagtttggatgttgatgaatatgtgtatccgtctgattttgatcttggagatgatttaaagggcacaaattcagaatctgatgcaggatttgaagaattatcagcaatgatcggaacgtatcattatacttccgattatggaacaggtcgattaatgattgaagcgacagaggatggcattgatatttctgattatgaatcggaggacacctatagatttttggcaaatgaaacaaatgtaaaaaatgaagaggaaaacaaagtatatctggaatacccggcacaggtgtatgaagatgatacggttatttttgagtattacattttagaaaaagctagtgatggaattgatgtgtattatagtccatcttcttttgacgaagctgaattattgtaccatgctgtcagggaaaactaaaagaggattgcgagatatcatatgataggttatattttattcaaatcaattttaacaaaaccaatttgaataaaaataaactaaatttgcagaaaggtgatttctatgtttattggcagagaaagagagttagcatccttaaaagaattctatgaaaaagacagaattgacggatgaggatgttttgctgcttacattggattcactttatggatgagacagaagatagcattgatgtcaaggtaaattataagcggaaagtcaattatgaacatctggcagagtgcagcatttccatgaatatcatgtcgaaggatacgaagaattttagaatttgagtttataagagccatccacagcggatggctcttattcataaaaatagaatgttcgcagtgcatattttttattcaaatcaattttaacaaaatcaatttgaataaatgagttttacaaggatggtgtagatgggtatatatcgtttgcggggcattttatccgggtggaagactcgccgccatatgtctggacacaggagaagagtattattccgcaccggcagtaatttaaaagagtcaaaagagtgatattgacgagtcagttcagttatagagatgatgaaagaaaatgattaatataaagatacaccagaagagaggtggacataaatcacactgtcacagagaggagaaaatgtatgaaaaaaagaattctagcagctatgcttactttgtctatggttgtgtccatgacagcatgcggaaattcagatgcaggaggatcaaaggattcagctaaaaataacggtaatggggatgaaccatatacagttaccatggttctgaatggaagcacacagccggatgaagaaagaatcgaacaaaaaatcaatgagattcttgaaccggaacttaatgcgaatcttgatattgttgtgctgccgtgggcaagtgcaagccagcagttacagcttatgttatcaggggatgaaaaaattgatgtcttttatacccaggcaaccaatgcagtgcagtatatgaatgcaggacagattgtagacatgtctgaactgattgataaatatggaacaaacatcaaacagatttatggagaggatatagctaagatcaatcagatcgaaggctttgtatatggcgtgccaaatcagattgaacgaggaagtattcctgccatatttatgagaaaagatctggtggaaaagtacaatattgatacaacacagattaaagaaccaaaagatctggaaagtgtttttgagacagtaaaagcgggagagccggatatgacaatgttatattcgagcagtgagaatgatgcaccggctacaagattattccgtggagatactctgtcagataacaattatcttggtgtactcatggatcagacgaacagcacaaaattagaaaacttctttgcgacagactggtttaaagatacaactaccatgctgcatgactggtatcagaagggatatatcagccaggatgcaggaaccaacacagagaactggagaacagtatgcaaggctggaaatttattttcactgtttttttcttatcatcctggaacaccggtagaatttgaaagctccaccggctatgattttgagatcgtgccattttataatgaaccgatcataaatagctcatcctataatggtgttacattctcaattgcccagaattcagaaaatccggagaaaacaatggaagtactggattatatctacggaagttcagagatcatgaatcttttaaactggggtgaacaggataaagactatgtgatagaagatgctgataatggcattatcaatttcccggaaggaatcacttctgataatgcaggctataacttaaaccttggatgggaattgccaaatcagtttattgcttataaatggactggttcagatccgcaattatgggaaaaaatggaagaatttaacggttctgcaaagagctccaaagcagtaggatttttatttgacagcagtaattgttcaagtgagatcgcagctctttccaatattgtaaaacaatacagcggagcactttacagcggttccggagatccagatgaacttattccggaattgttagaagcattagatgatgcgggaatcaatgaagtgatccaggcaaaacaggaacagttagatgcttttcttgcagcaaaataattaggttcagaagggaagtcccacagataaagcgtgggacttttttcataaaaggagaaacttatgaagaagaaaaagaacaaagttaaggaatatctgccgctctatctgatgatgcttccgggattattatatctgctgatcaataattatcttccgatgacaggtattatacttgctttcaaaaagttgaatttttcaaaaggaattttggcaagcccgtgggcaggactggataattttaaatttttgttctcgtcaaaagatgcctggattattacaagaaatacattgctatataatatagcgtttattcttgtcaatatggtcgttggaattgcaatcgcaattttaatctgtgaagttaagaacacaaaaatgaaaaaaatataccagagtgctatattattgccatttttgatgtcgatggtcattctgagctatattgtgtatgcacttttaagtgccgaaaatggtcttgtaaacaatacgatcctgccattactgcatatagatccgatccagtggtatcagaaaccaaaatactggccggcgattcttatcattgcaaactgctggaaaggagtgggatacggatgtctgatttatattgcatctctgatcggtattgatccgacttattatgaggcagcaagactggatggagctacaaagtggcaggaaatcacaaaaatcacattgccatgcctggtaccgacaatcattacgctgttattattgagcattggaagaatcttctattctgattttggattattttatcaggttccgatgaactccggtgtgttgttcccaacaacaaacgtaattgatacgtatgtatatcgtgcgttgatcgaacagggaaatatcagtatgtcatccgcagcgggtgtataccagtcattagtaggttttgtcattgtcatgttaagtaactggatcgttagacgtgtagataaagacagagcattgttttaggaggagagtccattatgacaaattcaaaaaaaacaaagagataccagttttggatcaatctgatactgatagtgatgacattgactattattttaccatttttgctggtatttatttcatccatcacggatgaaacagtgttgatccggaatggatattcctttttcccggaaaaaataagcttttatgcatatcagtatattatcagacagggagagaaaatactccgtgcgtatggcgttacaattcttattacagtagtaggtaccttttttaatctgatgttttcagcattactggcatatccgctgtctgtgaagacattgccttatagaaggcagattactttttttgtattttttacaatgttatttaatggcggtttagtacctacatatctgatgtatgtaaattattttcatataaaaaatacaatatgggcactgataattcctaatttgttgctgagtgcgaacaatgtgctgatgatacggagctattttatgacaagtattccggaagcattgtatgaagcggcaaaaattgatggcgcaggacatacaaaaatcttttttcagattacgtttccacttggtaaacctatccttgtgaccatgggattattttcggcactggcatattggaatgactggacaaatggtttatactatttatcaggaaatcagggacagaaattatatagtatccagaatcttttgaatcagatgatcactgatatccagtatcttgcaagcggtaaggttgccggaaatataggggcagaagttgcaaaacttccgacaacgtccataaggatggcaattgcttttatagcaatgcttccattatttatcatttatccgtttttacagaaatatttcgcagagggtattacgctaggggcagtaaaaggttaaaggaatatcatggcgtttggaaaaaagatgaatttaaaaagacgaaaaaagaaatctttagcacaacagagtaagcaaatattaattttaatgacagtcattctggtaattattctgggaggatgcacttatgttttaaacaaaacaagtgggcagatttacgaacagatgagccagatggcacagttgtatgcgcaggagcttgacaatcgttttttgaggatcagccggaatcttttttctacgatcatggataccaatgagacaaattccacgttctggggaaatgtaaatctgatgaagaatggggattattcggagtatgcgatcggaaaactcagagaagaatatttttcttcggcatgggaatatggaacggaatacaggatttttttatacacacatgatacggataaattatatcagctttccctgtcttcggacggaaattacacaatgtcatctgatattgcagcatctatccgtgaacagatagacaaattagatgaaaagacatatgcagtgaagcggaagtgggatgttttggagtgcgataatgaggtatatatctgtaaaattgcacaaaaaaatggaattgcattaggatgcattgtaaatgtaaaaagtatcttagaaccattctcaaagctttcgttgggaaagcatggatatgtaagccttgtcgatcaggatgaggtctgtataggtatgttagaccagagcggaatcatatcagagccgcaaagtatgaataccaaaaatacttatacgatccgtcagggattatccagagcaccctttgagatcaggatcgggatttctttaggcggtgtcttaagcctgatggcgggaagtctgctcgggatgacagtattgatctttatgattcttattatgagtgggatattgctttttcatgtgtattccaatattatgaaaccgcttaaagtgttcacacaaaaccttcagcaatatgatgagggtggatatatgctgaacatgacggaaggaaatctgcttgaattagagcagattgatggaaaattccgtacaatgatccatcagatccgcaaattgaagatcacgctatatgaacgggaattagagaaacagaaaattgagatggattatctgaaaatgcagatccggccgcatttttatttgaattgcctgaactttatttacagcatgatcgactttggcgattatgaacacgcaagggcaatgacaaaaatcacttcggattatctttcatatatttttcggaatacaacggacagagttccggttttagcggaatcaaagcattgtgaagattatttaaaaatcctgctgctgaggtatccggataagtttacctattatattgaagttcatgatgaagtggcagatgcggagatatttccattcttaatacaggtttatgttgaaaatgctgcaaaacaggcattgatggcagatgaaaaaatgctgatctcagttacggtatatcctgaggacagggacgatgaaaaatacgttaatatttttatctcggatacgggaaagggatttccggacgaaatattatgtaaactacaaaatggacaaaacatttctgacaatggaaaacatatcggtatttggaactgtatgaggcggtttcagtattattatggggatcagggagagatccatttcagcaatagtccattaggtggtgccgttgtggatattcatgttccatataaaatcggaaggagcgatacacaggaatgaaattattgctggtggatgatgaacgttatgtgattgaaagtataaagaaaaatatctgctgggagcggacaggtattactgagatttatacagcatttacaatgaaacaggcgcaggaaattataacagctgttaaaatggacattattatcagtgatattgtgatgcctgctgcaacaggatttgatctggtgcaatgggtgagggagcagaatttcaggatacaggttatttttttgaccagttatgcggaatttgactatgcaagacgtgcgatacagctggaaagcgttgaatatctgctaaaaccaattgattttgaaaaactggaagaagcattaaaaaaagcagaacaggcagtgcttcaggaaaaacatatcgaaaaacttacagaagcgagtgaacagtgggaaaaagaccggacaatcctgcaaaaggatatctggagaaatttattgagcggtaacatgacacaaaaccagttctgcgaatctgcaaaaaggatggatctgtatcaggatggattgatatattttaaactgatctgcttttatatggatcataaagcggaagagacacaaaagtgggaaccttcgaccatcgaatttgtcatgcaaaatgtgttgacggagttatttaattccttttatgccagagtggacaccatattttgtgaaaacgaatgtcgatactgggtggttctgtcaacggataaaatgccggaagaaggagaaaaaataagggaaaaagatctgctaaatcattttgtgcaatggataacagatcatgtacattcctatttttggtgtggagcgggaaattggagtggattttctgaagtgaccgcacaggctgacgatttgcagaagatgcgtgaaagcagtctgtcggtatggaatgaggttatatatctgtatgagttccagccaagtggaacagtctataaaaatccggagctggatacatggaaaacccttttggcaggggaggaagtggaagcagtcatagcaagcatacgcagttatctggagacagtcaggaagaatgagatgatcacacggcagtttttgctgtcattaaggacggatgttacacagatggtgtatgtatggctgtcagagatggggatttatgccaatgcacttttttcagataaagagagtgagaattacatgcttggcgctgtaaatggatttaacgaaatgatggagtatgtagaaaatctgatgcggaaagcggttggatataaattatatatcacaaaagaagactctgtcgcagatcagatatgtacctatattgacagtcatttcagggaagagatacacagagatgaactggcagaattagtctatttgaatacagactatatgtctcggatgttcaaaaaagaaaagggagtatctataagcaattatatattgcagaaaagggtagacgaagcaaaaaaacttttgtgtggcagcagtattccaatcaatacggtttcattacatattggatatagtaatttttcctattttacaaaaatgtttaaggagaatacaggattgacaccactggaatatagaaggaaatttggagaggaaacacacgtatgacagaacagaaattaacagaacttttgagagacatgtctctggaagaaaaagtaaatcagatgagtcaggtgacaggaggattttttaatggtgaaatcgttgtcacaggtcctatggcagataagggatttacagaagacaatgtaaatcttgcaggatcagtcatcggatccatgggcgctgaaaccctgaaaagtatacaaaaaaactatatggaaaagcatccgcaccatattccattgctgtttatgctagatgtcataaatggttataagacggtgtttccaattccgcttgcgcagggagcttcctttgaaccggaattgtcagaacagtgtgcatctgtggcagcaaaggaggcttcggtcagcggtcttcatgtgacatttgcacctatgacagatctggtaagagatgcaaggtggggacgtgtcatggaatcaacgggagaagatccttacctgaacagtctattctgtgcagcaatggtgcgtggatttcagggaaacagcttgaaagataactatgcaattgcagcatgtgtcaaacattttgcaggatatggtgcaccgacagcagggagagattataatacggtagaactttcagaacatacattcagagagttctatctgccatcgtatcaggcgggaatagatgcaggtgcagctcttgttatgacatcttttaatacagttaacggaatcccggcaaccggaaataaaaagttgatgcgggacattttaagagagcagatgaagttcgatggtgtacttatatcagactgggcagccatcgaggagaccatttatcacggatattgtgcagacagagaagaagcagcagtgcgtgcagtggaagcaggcgtagatattgacatgatgacaggaatttacagtgaaaatctgtgtcagatggtcagggatggaaaaataagagaagagcttatagatgaggcatgtcttcgtattctgcggcttaaaaataagctgggactctttgagaatccatataaagatgcagatcagaaaaaagaaaaggaatatattttatgtgaggagcaccggaatctggcgagggaagctgcaaagaaatcttttgttttgttgaaaaatgaggaacatattctgcctttagatcaacagaaaaagatcgcctttattggtccgtatgtagataacagaaacctgtttggtgcctggtcatttatcgcagatgcaaaagatgttatgacgctgcatgaggcagtacaggaacagtacgtttcagaaaacagtacattttgccagggatcaccaatgttaggggcggatgtatgtctggaaggatttggagaacaacagcagcaatcctatactaaggagcaggaggaacatatgctgcaagaggcggtacaggcagcagaagaggcagatatcgtagtacttgcaataggagaagaccgtttacagtcgggtgaagcaaccagtaacgcaaatatcagaatccctgaggtacaggaagcattgcttgatagaattgcggaagtcaatcaaaatattgtagtggttttattttcaggacgcccgttagacatacgtgaaataaacaaaaaggcaaaagccatccttcaggtgtggctgcctggaacagaaggagcgagggcaattgcggacactttatttggaaaatataatccaagcggaaaactgccgatgagttttccatactgtgtaggacaggtaccggtacattataatgaatattcaacaggacgcccacatgtagaaggcaaagataaagacagattccgctcgaaatatctggatattccaaatgagccattgtatccatttggatacggtctgagttacacaacatttgaggtttcagatattcatttggatcggacatggatggatacatcgggacagatcgaagcggaggtaactgtaaaaaatacaggaaactgcacgggaacagaaaccctgcagctttatatccatgatattgcggcttctgtagtgcgtccggtcagagaattgaaagattttaagaaggttacgcttcgtccgggagaggaaaagaaggtagtttttaccataacagaacaacagcttcttttcttgacggagaatggaatctatgagagcgaagcaggagaatttgaaatatttatcggaaaagatagttcgacagataataaagcttcatttgtattgaagaaataaggaagaagtgaaaaaaggcttccaacccatccgggctggaagcctttcccatccattcttattttgtcttagatttcttagcggccttttcttcattcatggattttttctctttctgaagttctttgttggcgctctcagcctttctctttaacttggttctccagcttactttgccttcaggtttctctaatggaccgcggacaccggtaactttcgtgatataaataccacttactgtagctttgacttcttttttcacagggatcatatcaaaacatgcatcatcagcgatcagagtcataacctttggtccgaccttagcctttacgatcggaagcttggaacggcgcataagctttggtgtctggtcaatgactgcctgtggcagaccggactggttcagacgcatcctcttcttatcaataatcaacatagtaacagtctgtgcagttgcagcaagctgtgcatcctgctcgtcttttctcttctgagctttctttccgaggaaatataaagcaattgttgcagcaataagcactgctaaaataactaataatacaattgttactggactcacaacgaaaatcctccctaatttcaaattcgtgttttattgtagcattgatttttggaaaaagcaatgtgattttggggaaataccttttattttagggaaaattgtgatatgttataaaagttagacggcagactccgtcttttggatttccggcagaaaagccggaaaaggaaatgaggaaaagaaaggtaagattaaatgaaaaagagagtgttagcacttttattgtgtgtatccacagcgatcagcatgacaggatgcggcagcaaaggtgaatcagttgaggcaacggaagcagtagagaacaccgaaagcacagaagaggtgccggcagttccgcttgcacaatatgatctgaagggatcggattatgtgacattgtgtgactacagtgcaatcccggttacgatttcaggagattatgacgtcacagatcaggatgtgcttgattatgtggaaaagatttttacacagggcggacctttttatacggctgatccggacaagacaacagtggaagagggcgacattgtaaacgtagactatgtcggaaaattagacggtgaggcgttcagcggcggaacagcagaggatcagaatattgatgtgtccaacaattcttccgcaagcggttccggttacattgatggatttacagacggactgatcggtgcatcagtaggcgatgtgatcgattctaatgtgacgttcccggatgagtacccgaataacccggatcttgccggaaaagaagttgtatttacgtttacggtcaattctatccagaaggaagtgaccatggatacgatggatgatgaatttgcatcgaaacagtttggtgcggattccgtggatggagtgtacaagcaggtacgccagtatctggagtccagtgcagagagcactcataaaaatgatatttattccgctttggaggattatctgttagaaaattgtaccgttgatatgccggcagattacagatctgatgtgatcgaagcgatccgtgccaatttcattgaccgttattgctccggggatgagagccagatggaaacggtactcagctcttacggctatacagaagagagcatcgagcaggaatggtctgacagtgtggagagcagtatcaggttagaactgatcgtaaaagccattgcagaaaaagaagatatccagattgacgatacggagtttgaagattatgtaagcacgatcgtaagcagcggcggtttcggtgatgctgatacgttatatagtaactatggttatggcgattatgtttacggaaagaatcagatccgtgtgatttatcttgcaggattagttttagataaattggcagagacagcagaggttacggagaacgcagtagaagaaacgacagagtctgtggaaagtacagaatccgcagacagcacagaagaataagaaaacgataccgaaacagaggtatgagatcataaaagagtcgacagacgttgatgagagaaagggagagtagaaaaatggaattagtaaatgtaagagatttattccgcagacaggatgagtatgtggatcagaccatcgcgatcggtggctgggtgagaaacatccgtaactccaaaaactttggatttatcgtggtaaacgacggaactttttttgagccggtccaggttgtttattccgatgttctggaaaattttgaagaggtagaaaaattaaatgtcggagcagcgattatcgttaccggtaaattagttgcaactccgggcacaaaacagccatttgagattcaggctgaaaaagtggaagtagaaggtccttctacaccggattatccattgcagaagaaaaaacacagctttgagtacctgagaaccatctctcatttaagaccgagaactaatacttttgaggctgtattccgcgtgcgttccctctgcgcttatgcaatccataaatttttccaggagagggatttcgtgtacgtgcatacaccactgatcaccggaagtgattgtgagggcgccggcgagatgttccaggtaaccacacttgacatgaacaatcttccaatgacagaggatggaaaagtagattacagcaaagacttctttaataaaccgactaatcttactgtaagcggacagctgaacggtgagacttatgcgatggcatttaagaacatctatacctttggacctactttccgtgcagaaaactccaacacgacaagacacgcagcagagttctggatgatcgagccggagattgcatttgcagatttagaggatgacatgatcttagctgagagcatgttaaaatatgtcatcaactatgtgttagagaatgcgccggaagagatggcattcttcaataactttatcgataaaggactgttagagagattacagcatgttgcaaactctgatttcgcgcgtgtaacttacacagaagcggttgaaatcttagagaagaacaacgacaaatttgattacaaagtatcctggggctgtgaccttcagaccgagcatgagcgttatctgaccgagcaggtattcaaacgcccggtatttgtaactgattatccaaaggaaatcaaggctttctacatgaagctgaatccggacggaaaaacagttgcggcagtagactgtctggttcctggcatcggtgagatcatcggaggaagccagagagaggatgattacgaaaaattacttgcaaggatcaatgaacttggactgaaagaggaagattacagcttctatcttgacctccgtaaatacggttctgcaagacatgcaggattcggacttggatttgagcgctgcgtcatgtacctgacaggtatgtccaatatccgtgacgttatcccattcccaagaacggtaaataactgcgaattataaaattgtatttcatatcgtaggtgattgcgaaaacaattgtgttttttgtcatctacgatatttttagacaattgcgaaactcatgaaaatctaaattcaattgtgaaaaattaacaaaagcttgagaaaacactgggtgagccaaaatcgaacaagttcgattggtacttagaaggtaggtacgatgtcaatcgtgactggcttcttagtaccattaccagcgacacgtagcgggagcgtgttttcgaaaattttgttgattttgaacaattgaaagaagagtaggatgagtttcgcaaacgcctatcgatatttagatgacaaggagaaggattgtatgagatatgttttggaaaatgacacattgcgtgtggagatcgattcttttggggcagaactaaaatccgtaaagagaaaatctgacgataaagagtacatgtggtatgcggacaaaaaatattggggaagaacctcccctgtgttgtttccgtttgtggggaactgcagaaataaagaataccgctatggcggaaaaacgtatgcaatagggcagcacggctttgcaagggatatggaacatatcatggaatcccagacagaggacaccatctggttttccttacattccaatgaggaaacgatggaaaagtatccattcgcgtttgttttgaaaattggatacaaactggcaggcaatgaattaaaagtcatgtggaaagtggaaaacccggatacaaagaccttatatttttccatcggcgcacatccggctttcttatgtccgtttcatgacgaagaaagcaagcttggatatggtctgcaatttgcaggactaaaggaagtgcatcatcatggaaatacaccggataccggactggcagtaatgagtgaagatattgtgatcccgttggaggatgagaaagtatactttacaccgggatttttcgatcgctgcacttatatggtggaaggaaaacagaccggggaagtttcactggtcacaccggatggaaagccttatgtgaccatggattttgatgcacctttatttgcgatctggtcaccggaaggaaaagacgcaccgtttgtctgcattgaaccttggtatggaagatgtgatgcggatgattttgagggcacattagaggaacgggcatacgggaacgcagtggagccggagcaggcatttgaggcttcttacagcatccgttacctgtaaaaagggagaaagatttcatctatcccggaataacataagcgggctttgaaaaaaatccgcataagcagccggattgcttcatatatatagacagaagtgaaagtctggcggtggcggattgggaacaggattgagattaagggcgagagatgcaaaggaaaacccggcaaaagtgctggcaatggttctttttatcatgtttatcataagtgcgttattgttattgcttctggcattgcttttataccggctggagctctcggaggcagttgtcaaagtggcagtgatcgtgatttatatcataacggggctgactggaggcattctgatgggaaaaaagatcaaggataaaaagttcctctggggatttgtggcaggaacggttttttttggaattttgtttgccgtctcactgatcataaaggggggagcaggcattgaaccggtgaaaatgatcacaacctgggtgctctgtgcgtgtgcgggaactgccggcggcatgatcagttaaaaaaatgcttttcttatgaaaaactatgtgttatactatagaacagcaaaaaagatgttaaaggagaaataatcatgaaacacgttaaaacattaaatactagaaaattacagaacacagtaaaaaaaggtggatgcggcgaatgtcagacatcctgccagtctgcttgtaagacatcctgcacagtaggaaaccagacttgcgagaacagataagtttaagcctaaaagtgaattatgacactcacaaacgaccgttcgcgcagcgtgcggtcatttgtacgttatagatatgtgtaatgatcctatatattagaggaaaagaagatagaaagtgaggaaatattatagtggttcatcagtataagaacaacggctatgatattgttctggatgtaaacagcggtgcaatccacgtagttgacgatgtgacatatgatgtcattgagatgtatgctgcacgtgagagcgcagcagatacctctgcggaagagattgtaactgcattatccggcaaatatggaaaagaagaagtagaagaagcgattgacgaagttcagacattgatcaaaaatgaggaacttttcacaaaggacacctatgaaaactatatgatggatttcaaaaagcgtccgaccgttgtaaaagccctttgtttacatatcgcacatgactgcaatcttgcctgtcgttactgctttgcagaagagggcgagtatcatggaagaagggcattgatgtcctttgacaccggtaaaaaagcattggatttcctgatcgcaaattccggtaacagaagaaacttagaggtggacttctttggtggagaacctcttatgaactggcaggttgtaaaagacctcgtagcctacggaagagagcaggagaagatccacaacaagaacttccgttttacacttactacaaacggcgttttattaaatgatgagatcatggaatttgccaacaaagaaatgggcaatgtggttttaagcattgacggaagaaaagaagtccatgatcatatgagaccattccgcaagggagcaggaagctatgacctgatcgtgccgaagttccagaaatttgcagagagccgcaatcaggacaagtattatgtgagaggtactttcacacacaataaccttgatttctccaatgatgtgctgcatctggcagatcttggattcaaacagatctcagtagagcctgtagtggcacagccaaccgaggattatgcaatccgtgaggaagaccttccacagctttatgaggaatatgacaagctggctgctgagatggtaaagagacataaaaatggaaatgatttcaacttcttccattttatgatagatctggagggtggaccgtgcgtggcaaaacgtctttccggctgtggttcaggaacagagtatctggcagtgacaccttggggtgacctttatccttgtcatcagtttgttggaaatgaggatttcctgcttggaaatgtggacgagggtatcaaacgtcaggatatctgtgatgaatttaagtgctgcaatgtttatgcgaaagaaaaatgccgtaactgttttgcaaaattctattgcagtggcggatgtgcagcaaactcctacaatttccatggagatatccacaatgcatacgacatcggatgtgcacttcagaaaaagcgtattgaatgcgcgatcatgattaaggctgccgaggcagacgaagaataaaggaagggtaaaacaatgaaaaagagtaaagcagcagtcatattggcagtgatccttgcagcgtttgtgggacttgcttattatgcatcaattattctttcatccaccggaatcggtgaagatatgtcaattcctctgggactggatctctccggtggtgtttccattacttatcaggtagtggacgagaatccaagtgctgaagatatgagtgataccatttataaacttcagaaacgtgtagacagttacagtacagaagcttccgtatatcaggttggagacgacaggatcacagttgagatcccaggtgtacaggacgcaaatgagattttagaggatcttggaaatccgggatctttagagttccagatgccggatggatcagttttcatgaccggtgacatggtggaagatgctcagggagcaacagcgaccgacagatatggaaacaaacaatatattgtatctttaaagttaacagacgaaggtgcaaagatattcggtgaagtaacaagcgagaatattggcaagaaccttccaatcgtatatgatggggagacgatcagttatccgcaggtgcagagtgcaatcacaggtggtgaagcacagatcacaggaatgtcttcttttgaagaggcagataatctggcaacccagatccgtatcggttctctttctttacagctttccgagttagagtcctctgttgtaggagcacagttgggaagccaggcgatcgcctccagtttaaaagccggtgcgatcggacttgcgatcgtcatggtatttatgatcgtgatgtacgcagtaccgggtattgcagcatccttagcgcttgcaatttatacaactttagtgatcgcaaccttatatttattcgatattacactgacgcttccgggtatcgcaggtattatccttggtatcggtatggcggtggatgcgaacgttatcgtatttgcacgtatccgcgaggagatcgcaaccggaaaatcggtccagacatctatgaagatcggtttccagaaagcgatgtcagctatcttagatggtaacattacaaccctgatcgcatctgttgtgcttatggcgttaggttccggtaccgtaaaaggttttgcctatacgttaatgatcggtatcatcctttccctttttacagcaatggttgtgaccagatacattctgtattctctgtatgcattgggacttaagagtgaaaaactttacggtcgtgcaaaagagagaaagagcattgattttattggaaaaaaagcagtattctttacaatttccggtatcattatcgctgccggactgatcagtatgggagtacattccgcaacagagggcaaggcattgaactatggtcttgactttatgggtggaacttccacaacggctgattttggcaaagatatgaccatcgaggatattgagaatgacattgttccttatgtggaaaaagtaaccggggattccgatgtgcaggcaacaaaagtagaaggaacaacacaggttacaattaagacacgtaccttaagtcttgatgagcgtcaggaattggaagatacactggcagaaaattgtgatgtggatgcatccaccatcacttcccagagtatcagttctaccatcagtggtgagatgcgttccgatgcattgaaagcggttatcgtgtcctgtatctttatgttactttacatctggttccgttttaaggatatcagatttgcagcaagtgcgatccttgcattggttcatgacgttcttgttgtgatcacagtatatgcacttgtgcgtatttctgtaggaagtacctttattgcatgtgttcttaccatcgtaggttactctatcaatgatacgatcgttatctttgaccgtatccgtgagaacctggcattaaagaccggaaaacagactgcggaggaattgcgtgaagttgcaaataagagtctgacacagacattgtccagaagtatcaatacttctattacaacttttattatggtcgtaatgctttacattttaggtgtggcaagtatccgtgatttctcacttccacttatggcaggtcttgtatgtggtgcttattcttctatctgcatcgcaacagagttatggtatgtcatgaaagtacatttaggaaaaaataaagcaacaaaatagttgtgaaataggaaaacggctgccttctggcggccgtttttgcatttcacatttacagaaaaaacgaagggagacaggagaatgcaaaaaggacttttgatctatctgatcgttatgaatctcattggacttgcagtgatggcaatggacaaaagcaaggcgagacatcatgcatggcggataccggagaaaacacttttccttgtgagtattttaggcggcagtgccggaacgtgggccggcatgtatctgtttcatcataagacaaagcactggtattttgtggtgggaatgccacttatcctgatcttacagatatgcattacggcattgatcgggaatatgcatgggtttgggatgtgataaatgcatggtttgcgatgttttataagaaatagaaaaataaattagcaattgaatattttcagaaagtcctttataatgaagtttaaaatctggcggaagacaaggaggattttatgtacacattagaagatattcaggcagtggatatggaagttgcacaggcaattaccgatgaacttgacagacagaacagtcatattgagctgatcgcatccgaaaactgggtgagtccggcggttatgtctgcaatgggaagtgtcctgacgaataaatatgcggaaggttatccgggaaagagatattacggtggctgcgagtgcgtggacgttgtggaagaactggcaagagagcgcgcaaaagaattatttgggtgtgagtatgtcaatgtgcagccacattccggtgcgcaggcaaatatggcggtacagtttgcaattttaaagccgggtgatacgatcatgggaatgaacttagaccatggtggacatctgacacatggttctccggtcaatttttccggaagttattttcatgtagtgccatatggtgtcaatgacgagggattcattgattatgataaagtggaagaacttgcaatggaatgtaaaccaaaaatgatcattgcaggagcatctgcttatgcgagaaccattgatttcaagagattccgtgagatcgcagacgcatgtggtgcagtgctcatggtcgatatggcgcacattgcaggacttgtggcagcaggacttcatccaagcccaattccgtatgctcatgtagtgacgacaacgacgcataagacactgcgcggaccgagaggcggaatgattttgagcagtcaggagattgcggataagtataactttaacaaggcaatcttcccgggcactcagggcggaccactgatgcatgtgatcgcagccaaggcagtctgcttcaaggaggcattgcagccggaatttaaggtttatcagcagaacattattgacaacgcacaggcactctgcaagggactgatggatcgtggaattaagatcgtatccggtggaacagacaatcacctcatgctcgtagatctgaccaattatgatcttaccggaaaagcagttgagaaacttctggattccgtcaacattacctgcaataagaataccattccaaacgacccgaaatctccatttgtgacaagtggtgtacgtcttggaactccggcggtaacttctcgcggattaaacacggatgatatggatcagatcgcagaggcgatcgcaatgatgatcaaagagggtgagccggcagctgacaaggcaaaggcaatcgtgaaatctttgacagagaaatatccattgaaataaaataaatttttttgttgaataagaagtggttatctgcttcatgagtaaaaaagcctcccgataaaaatgtgggaattgcgatgaaaggcaatccggatcatttttgccgggaggcttttgtggtttaggaatgcagcgttttgcaaaaaaataagagtttagcagaaatgatcatcttgcgagcacatcaatgatctgtccaacgtacatggtgtgcatgtcgccgtctttgtaccatttgtcagcaatctcggaatcgaggaaggaatcatccgtgattctggtagcagacattttttcacagaccaaaacaagatttccctcatcaatgtatgggattccatgccggtagtccacggtaagccctgcgtttgcaatcttatcctcgttccggccggaatgggagccacagtaattcaaggcatcgcggtactggtcacttacaaatgtaagggagaaaaagtctcccgcatcgatcagttccttggtatatctggaatcacggacaaaaacatagacaacatttttgccccataaaacaccaacaccgccccagctaatggtcattgtattggattcctgtttatttccggctgtgagcagtgcccattctttgccgattttcgtaaatggattcatgtccagcatatcaactggaattggctgaaatgtatgcatagggatcacctctcataatttttttaggtagttttattatattacaggagagtggaaaagtcacttgaaaaagaaaataaaatcaggttatagaaaataaaacagataataactaatagttatacataacataaggcttcggaataatcttgacatgaaaaaaagaaagtatcataatggttgtcaaagttaatttcccaaaagtgtaatgggaaaaggaggccaaatcctctgctcctgtaaggacagtcgcatttgcttcgcaaacaaggaggatattatggatatcagatttgaaaaaagaccggtattaaaggagaaaccagaccagaagaatcttggttttggtaagtatatgacagattacatgtttgtcatggattggacaaaagaagacggatggaaagatgcaagaatcgttccggaaggacctatcacaatggatccggcatgtgtgacacttcactatgcacaggaaacatttgaaggtatgaaagcataccgtacagcagaaggaaaaatccagctgttccgtccagagatgaacgcaaagagaatgatcaattccaacgcaagactttgcatgccggaattcccagttgatatgtttgtcgaagcagtggaagcacttgtaaaagtagaagctgactgggttccatctgaaccaaacacttccctttatatcagaccatttatgtttgcaacagaagcagcactcggcgtacatatggcaaacgcatacaagtttatgattatctgttgtccggtaggtgcttactatgcagcaggtcttaatccggttaagattctggttgaggatgaacttgtccgtgcagtaaaaggtggtacaggctttacaaaatgtggtggtaactacgcaggttctattctgggacaggtgaaagcagaaaaacttggttatgcacaggttctctggttagatggtgagcatcgtaaatatgtagaggaagttggaaccatgaacatcatgttcaagatcgccggtgaaatctacacagcaccaatcgaaggaaccgttcttccgggtgttacaagagattccatgatccatctgctccgtgactggggctacaaagtaaatgagacaagactttccgtagatgatctgatgaaagccggacatgacggtacattggaagaggtattcggtacaggtacagcagccgttatctcaccagttggagaacttcgttacaaagatgatgttgtgacagtcaacaactttgagattggagaactgacacagaaattatatgataccttaaccggcatccagtggggaagaatcccggataaatatggctggacagtagaagtaaaataacttctggacatttttcacatatcatagtatagtaatcatgttatagatgccttcatagatgtagcagcatttatgaaggcatttacaatatatatagcacattgataatcgaataaggtttatattttcagatatgcgatcctgtctgtgactgattgcagacatttaggtttctcttctagcgccatgtacctgtgaggacgaccatacacaggttaacgaggaaaagggttatcgaaaattcggcggacgccctttcgtacctcccagtgcgagatatgccggcaaatatgcaggtgactgcaaaacaaatacggtataatgggacaattgaattcgaatatgatttaaattttaaatagaaaagaagaggaaatttaatatgtgtggaattataggttatacaggcagtgaaaacgtaaaagatgttttattagatgcgttggaattattagagtatcgtggatatgacagtgcgggtattgcagtgaaagacgaaacttcccatgtgacaaatgtttataaatgtgccggaagagtaagtgatttaagagcaatttgtgatgcgaagaagattttgtctacctgcggtatcggacatacaagatgggcaactcacggtggagttacagaccagaatgcacatccgcatcagcagggaaaagtgactctggttcataacgggatcatcgaaaactatcgtgagctgatcgctgattacgatttgcaggaaatccttcattctgaaacagatagtgaagttgcggctgcattattaaatcattattacaagggagatccaaaggaagcgatcaaaaaaacagtgagcaaattaaagggtacctttgcgcttgtgatcctgtttgaagatcagccggatgtgatctactcgatccggaatgtcagcccgatcgttgcaaccatatgcaaagagggagcaatgcttgcatcagatctgactgcactctgccgttttacaaatgaatactttgttgtaccggaatatcacattttagagttgcacaaagatcatgtggtacttacggatttaaatgacaatgtggtagaaccggaatttttgtccgttgactgggagttgaacagcgcgggaaagaatggttatccattttatatggaaaaagagattatggagcagccggaagcaatcaggaatacgatcaaagaccgtatcgtgaacggtctgcctgattttacctcggatggtgtgccggattctctttttacagactgtgacagaatttgtgtggtagcatgcggaacagccatgcatgcgggacttgtggcacaggctctggtaaaatctatcgttcatgtgcagatggacgtagaacttgcatcagagtttatgtattccgatccggtcattgatgagaaaacattggtgatcgcagtatcacagtccggtgagacaattgataccttggaagcattaaaatatgcgaagagacagggcgcaaaatgtttatccgttatcaacgtaaaaggttcttccattgcaagagaaagtgattatgtgttatacaccgcagcaggacctgaaattgcagtggcaagtacaaaagcttacacaacacagctttccgtattttatcttgtggttgcaaaaatggcattattgcgaggtgtctacacagaggagcagacaaagagctttatcgcagaattagagcgtgttccggaagtgatgcagaaagtattggagaaaagacgtgacatccatgtgatcgcaaagaagattctggaagcaaaggatctgtttatgatcggacgtggactggattactctattttactggaaggatcattgaaactgaaagaggtttcttatattcactctgaggcttatgcctccggcgaattaaaacacggaccaattgcactgatcacgactaacacaccggttgttgcaacggtaacacaggaaaaactcatgtcaaaagagctttccaatattaaggaagtaaaatccagaggtgcagatattgtattatttatcaaagaggcactttccggtgatcttgataccgaatatcaggtgatcaagcttccggatatgcaggatgaatttatggttttacctgcatcggttgcattacagcttttagcatattacgtgtcatccgataagggatttgatgttgataagccaagaaatctggcgaaggtagttacggtagagtaagaattaagttttgggggatttggataaagaacggaaataaaaattgagaagttgggaaatcgaatgttttgcacaggaagcagaacaggatcgcatgtctgagcatataatataaggaaatataggaagaggttgttcatgccagatatcaaatatgcccagacagaggctgtagataaaggaagcctcaaggtagaagtacttgcgaaccggaccagacgaccgatcgagggagcgaaaatcacgatttcctattcgggcaagccggattccacggtggaggaggtaagcgcagatgattcaggaatgtcggagaaacttacgcttgatgcgcctccgcttgaatactcgatggaaccctccgaaaatcagccatttgcccaatatacggtcaaagttaccgcaccgggatatcgtcccgtcagtatttcgggtgttcaggttttttcagagcagctcgcattgcaacaggtgcgaatggcggaagaaaatgaggaagaaaatcaaatagattccattgtgattccggtcaatacgttgtttggcaatttcccggcaaaaatagcagagtccgagatcaagcctgtctccgactcaggggagatcgtgctgagtaaagtggtgatcccggaatttgtcgttgttcatgacggaccgccatcggatcccaatgcggcaaattattatgtccgttaccgggattacatcaaaaatgtggcatccagcgagatatacagcacgtggccggacagcacgctgcgtgccaatatccttgcgatcatgtcctttacgttaaacagggtttacacggaatggtaccggaacaaaggctataacttcaccatcacaacatccactgcttatgaccagaaatttgtatatggaagaaatattttccagagtatctcggatgtggtagaggaaatgttccagaattatctttccagaccaaatgtgagacagccaatcctgacgcagtattgtgacggacagcgcgtgacgtgcagcaactggctgagccagtggggaagcaaatatcttggggatcagaactacgaaacgatagaaattctccgttattattatggtgataatatgtttatcaatacagcggaggagatttccggtatcccggcatcctggccgcggtataatctggaagtgggagctgccggagataaggtccggcagatccaggaacagttagcgagaatctcgcaggcttatccggcaatcccgacgatcacaccggatgggatttacggagaggcaacgagggcagcagtagaaaaattccagtctatttttggcttgcctgtgacgggagtggtagattaccgcacctggtataaaatatcggagatctatgttgcggtgacaaggattgcagaactggtataaaatgcggagtaaatgtgccgggggattggtatttttcagttccccggcacaaaaacgtttcaggaacagatcgcagactaggatttgagtggaaagtgtgttaaactaaaagacagtttaaattgcagtaaagcagggataaaaagtatgaacaactataaaatcacaatccagtatgacggaacaagatacaagggctggcaggggcagaacagcaccggtctgaccattcagggaaaaatagaagcagtgctgggacagatggcaggacatgcggtggaagttattggttcggggagaacggatgcgggcgtgcatgccaaaggccaggtggcaaattttcatattgaggagcattttacggagggaaagatcatgtcctatctgaatcattatctgccggatgacattgcagtcattgcgattgagcaggtggacgagcgttttcacagccgttacgccgcaaagaaaaagacctaccgctatcacatccatatgggagagatctcggatgttttcgagcggaaatatgagtaccagtatgagaaaagactcgatgtggagagcatgaaagaagccgcttcctatctgatcggaacacatgattttacttcattttgcggaaataagaaaatgaaaaaaacggcagtccgcacaatttatgagatcaattttacgaagaaagggaatgatctctggatcgattaccggggcaatggatttttgcaaaatatggtgcggatcctgacgggtacgctgatcgaggtcggggatggcaggagagcgccggaggaactgccacagatcttagagagcaaaaaccgggagaacgcaggctatacagcgccggcatgtggactgatgctgatggaagtgcattattaaaagataaattcataagaaaaaacaggcagcaggtgttacatggaaaaatggtttgtaatcaacaaaggggctgattttgaaaagcttggaaaagagttcgggatcagccctgtcacagcgcgtcttatccgaaaccgtgaggtgatcggggaggcggcatttgaaagatatctgaatggaagtttaaaggatttatacgatccacatttattgaaagatgcagatcgtttgacagatattttaaaagttaaaatagaagaacaaaagccggtccgtattatcggcgattatgacatagatggagttatgtcaacctatattttataccggggaatccaacactgtggtggaaatgtttccacgcagattccggatcgtatgaaggatggctatggaatcaatgagaatctgatcgatcaggcaaaaagagacggaatggataccattcttacgtgcgataacggaattgctgcaatctcagagattgcgcatgccaaagaacttgggatgaccgtgcttgtgaccgatcaccacgagattccctatacagaggagaacggggaaaagcagttccttcgcagcaacgcagatgcaatcgtgaatccaaagcagcaggaatgtgcgtatccttttaaagagttatgtggagcagcagtcgcatggaaagtgctgcaggtattgtatgaaaaaatgggttttgccctggaagaaacctatgaatttctggaaaatgtcgcatttgcaaccgttggcgatgtcatggatctgacagacgaaaaccgcattttggtgaaagagggattaaaccgcattcaccgcacaaaaaatccggggatgcgcgccctgatctttcagaatcatttagaaccggagcagatcaatgcatatcattttggttttgtgttaggaccgtgcatcaatgcgagtggcagacttgatacagcaaaactgtctctgtctctttttttacagggagaggaagaggcagcaaaaacggcaagggagcttgtggagttaaaccagcagcgcaaagatatgacagcagatggcgtcgaggaggcaaaatgtgtggtggaggaacattacatgtcggataaagtgcttgtcatttatctgccacaggtgcacgaaagtcttgcaggaatcattgcagggcgtatccgggaggcttatcataagccggtatttgtgctgacgaaggcggaggagggcgtgaagggctccgggcgttccatcgagaagtactccatgtatgaggaactatgtaagtgcagggaacttctggaaaaattcggcggacatccgatggcggcaggattatctcttccggaagaaaacgtggataagttccgtgaaaaaatcaatgcctgtgcaaatctcacggaggatgacctgattccgaagatcaaaattgatattccgatgccagcagcgtatgcggatgccggtcttatccgggaatttgcagtgttagagccttttggaaaagccaatatcaagccacagtttgccgacaaaaacctgagtatcacaaaggcttttgtggtcggaaaaaatcagaatgtgttgcggctgaatctcctgacagccgcgggagaggcggtatcggcagtctattttggtgatattgaggcgttcaaagcatattatgcagaaaagtatggaagtgcggaagtggaaaaagcttttcgcggtcagataaacaaattgaggataatgattgtgtactatccggagattaacgagtataatggagtggaaagcgtacaggttatcattcgaaattatcagtaaaagctggaggatggcatatgtttggtggaaaaaaagcaaaagaactggaagaggaacttctggcattacaggaaaaacagaaccgtctgcaggagcagatttctaatattgcaaaagcaaaagacagcgcagaagagacattggtacagatgacgatctcaaaaacggaactggatgagacaatcacggcggtttcagaggaattggaactgttaaaggagtgttcagaggcgaattcaggacagaccgtactgttgaaacagcagcttgcaaaaaagaatgaacagaatatcagattgcagcaggaaaaagaagcactctgccagcaaatggagggtgagcacgagaaaattgcaaaagttgtagagaagaacaagtacgtcaccacacccatgaaggagatagaatcgttctatgaggcatattgtcaggagagagagtctgttgaagaggcgttacagaaactggcagatatttcacagaatatgggagttctggcactcggcgcagcaatcgaggcaggacgcatgggagaagacggaagaaaatttgtgacagcggcagaggaagtgcgtgtgaacgcagagcagtatacttcggcggttgcggatgtgcttgcgaggatcagtggttttgaggaaactgccacagaggtggaaaaacagattcatgcgttaaatgatctcttaaaagaaaataacggttctctggtgaaacttctggaagacagggacacagaggcagtggaaacggatcatgaaaatgtggaagaagaaacaaatattgaagaaatattagaaagtctctgtcagggtgaaaatgaatttttcgaagtgcagagcagagtgttatccaaagcggaaacactgcgccaggagtggaaagagcacaaagaatgtgcggatgaattagaacgcaatgtggaggaagtccatcgtttcgtccagacagaataaagaagccacaggttttaaaatatatctaatttataatcatggaaaagagaggggaaaagtatgacaaaagaggagaagtttacatttttatcagcggatggcaaaacaaccatccatgcagtcaaatggattccggaagatggaaagtatgaggcaattttacagatcacacatggcatgatagagtttgtagagcgctacagaccatttgctgaatttctgacagagaatggctttatggtggtgggacatgaccatttaggacatggggattccgtagcatccaaagatgactggggatattttgcggaaaatccgagtgacacggtgatcgcagacatgcatgcactgcgcacgatgatccagaaagaaaatccgggtgttccttattttatgatgggacacagtatgggatcttatatgcttcggaaatacctcaccattcacaatgatgatttgagaggggcaatcattatgggaaccggttgtgtgccggacaatacgaccaaacttggaatcaacgtgtgcaaattcctggcaaaaatttttggctggcatcacagaagcaaactggtagaatcgctgtcgtttggcggaccatataagaaatatgatctttctggaaaaacactttcaaacagctggcttacaaaagatgaggatattgtaaaattttattatagcgaaccgcggtgcacgttcaaatttacattaaacggctatctggggctgatggaagcagttctctacgataatcagttggaaaatgtgaagaaagtaccaaacaagcttccaatttttattgtatccggtcaggatgatccggtgggagataatggtgtcggcgtcaaaaaagtgtatgatctcttcaaagaggcaggttctctggatattacatataagctttacgaaaatgacagacatgaaattttaaatgagacagaccgcgataaagtgtatgcagatcttcttgcatggatgagagtgcggatcgatacgtaaataaaaagagagggaaaaaaagtgaagagaaagagaatgacaaagagaattgcagcaattattttagctgcagtgatgatgataccaacacatgtaacatcatttgcagcagatgcttctgcgcagaactccaccgggcaggaagagagcaatgccacatccggtgattcccagacaacacagtcagagaataatgcagcaacgcagaatgacagcagtgcaacaggtgcagataccaatgccggttcgactggaaatacaggatcggatacacaaaacagcacagcttcagattcaaagagcagcacaagttcagatacacagaacagtacaggttcagattcacagagcaatgcaaccaataatgctgcttcagattcgcagagcagtacaacaacaaattctgacagcacaaatacttccaccagtggcacaaccgataatgttacaggtggggtaacggtagaagatgataaaaaatccacagaaaatgtgactggagatgtcattgtggatgagaataacgataatgttgagattaagaaagatgataaaccttatcttgcactcggcgcggatttgtccgatgaccagaaaaataccgtattatcccttatgggaatcgatcctgccaatctggcaaattataacgtgacttacgttacaaatgcacaggagcatcagtatctggattcctatgtggattcttccaaaattggaagcaagtcatggtcttctgtcgtgatcgtaaaacgtaaaaaaggaaatggattaaacatttctacgaacaatatcacatactgtaccgttggtatgtacaaaaatgcgctgacaactgctggaattacagatgcagatatcatcgttgcaggtcctaagccaatttccggaaccgctgcactggttggaatctttgaggcatatgaggcaatgaccggggaagcagtacaggataacgttgtagatgcagcgttaaatgaacttgttgtcaccggagaactggaagcttccattcagggtctgaccgatcaggaagtggaggagtttattgcttacatcaagtcactgatcgcagaaaaaggactgactgacgagaagagtatcaacgaagcaattgatgaagcctgtgataaatatggcgtcactttatctgatgatgagagacagaaaatcgtagatcttcttttaaaaattacttctcttggaattgatttaagtgggcttgtagattatgcagcatctctctacaattcctttaaaaatggaggaagttcttccggaatcattgcatctattggtaatttctttggaaatatctttagtgcgattggggagttcttcaaaaatctgtttaaataaccggagttttaactggcgtagtgcagcagattttgtggtgctttcttagggcttgaagggcagatataagagtcctctcacaagtcgtgattttataggtttatgaaaagaaaaacggtacagacgaaatatgatgttcctgttcgccaggcatttcgctgggcttctgaacaacaatcatgttcagctgaagcttccatgattgttagaatcccagctccatggctcacgaaggaaatcatatttgtctgcaccgtttttctttcatttacgttatgaatgacttgtgagaggacacttatacatgcccggtcaacgtcatgaattgcaccacaaaatctgcaatttacgttatggaactcacggttgtgggatgagtatctatctttgggctctgccgctcgcattcttacaacgtttctgtctgcagatccaaaacctgatataaggttgcggatacgatctcaaaattcagtgccggttcggcaggagattccattttgatgaaaaattcaatgcatgaaaaatttaatcttaattattacagttagcaccgttgcatttttatgacaaaatcttttacgtgcattgaaaaataccacacattctattatcataaaggggaatatgattgaacacaaacgatgagaaaatccaatggcatcctgcatttgatgcggcgttgcagatcgaacttggagaagaaacaaagtataaagccgatacggagaccgtagacttcataccggcagcagagctgacaattacttttgtatgctatcattatccaagaaccatgcttcagaaattgcaaagagaccggcagataacagtcgaaaatatggaaagcggtatttattaccttatgggagatgcaattccgatgcagcttatcattgttccaagattatctaaaacgaataactactggctgaataatcttcgtaatgatttaaagtcaggcggcgagatcagaaattttatagagaaatatggtgaaaacaaaaactcaaagttataccaggcgctggcagatacgatcatgcgtgcaaactggcaggaattaaaggaggaacgaaaaatgtgtgaagcattacgtgaattatttgcggatgatctgcgcgaatcaagggaagaaggaattatggagggcaggaatgttggaaaactcgagggaaaactcgaaggcgtagcttcaaaagtcatagaaatagtaattaaaaagtataaaaaaggctgttctgtaaaagaaacagcagatatgctggaagaaccccaaacgttaatcaaacaaatctatgatgtgatcggacagtgtgcacctgattataatgtagagacaatttataagatacttctggataaaactatataatatgtaacatccgtaggctggaacaagactggaagacggattttcataactggaatattgcatgccacacagccttggataaataaaaaatagaactgatttgttttcaggattttgattaaattgcaaatcgaagatatggaggcttatatgtttttaaactataacaatctttggaaaactcttattgataaaggtatgaaaaaaggtgaattatgcaaacagaccggaattagtagcagcacactttcaaaaatgaacaggaatgagccagtatctctatccataattttaaaaatatgtgaaacacttgattgctcaatagaagacgttgtcgcagtaagcaggaaagtagagtgaggtgcaagatgggaaactgtaaatttgcaaatgaattaaatagattgtgtaagtcatcgagtgattcaattgacaatacagaaaagtttgatgactttaaaaaatatatgcatgtaacaagaactgcagaggaagatttaaaagcgattcttagaaatgtaaatgccggaaataaaaagacgttagtgcttttgtgtggaagtgcaggagatggaaagtctcatttgttgtcatacctgaaaaattctgacgaggaacatttgatagagaactacacgattttcaatgatgcaactgagagtagtgcaccctcaaagactgcaatagaaactcttaatgaattgttagaaccatttaaggataatcaactagagattccaggaagaaatgtaattcttgcaattaacttgggagtattaagtaattttgtcgagtcagaatatggaaatgaattctcgaagttaaggagttatgtcgaagatagtaatattcttactacgcaggtaaacaataacgactttgatgaaaacggccattttcaacacgtgagtttttcagattatcatatgtacagcttgacaaaggatggaattcatgctggatatattgaagatattatgaaaaaagttttttctacggtggatgaaaatagattctatcagtcttataaaaaggattgcgaatcttgtccgttatcaaaaaaatgtccggttaagatgaattatgaatttctcatggaagaaaaaaggcaggtttatgtttctcaacttttagtagagacgattattaaagataaagttattcttacaacaagagaaatactaaactttatatataacattgtggtctctcaagaatttaactttgctgatattcaaaaatctttggtggatgattctacatacttgaagaagtttttgaagcagataacaccggctttattatttgactctactgacgtaacggtactaatgaatatgctgaataaatatgatccgcttagaatgagatcagaaaggactgatgaaattgctatttcatattatgtcagttcagacattagtaaagagattaaaaaagcatttaaagacgttccatatggcaaggttatttgcaacgagtcaatggtagccaagctgaatgatgataaggcattaaagtccattttatataatttgattgttagaatagatgcctttgataataatatttcggaagatgaggtctataagaattatctagctgatttgtttatttataacgccggaataggaaagaaacttgatagactttatggaattgttgaaaaagctttaacacaatggtgtggagctgatgaagatggaaatttatgtcttgatgataagcatgatggtttttcactttatgaagcggttgagtttaatgaaaatctagatcagctacctaaagcttcaggagaggatgaacttcagagatttattccttccgtagtagcttcattctatggtaatgatgatgaagtgataaatcttgatttggattattcgctttatgaattattatcaagattaaattcaggatatatccagactgcgaatgatagaaataatcatgcagattttataagctttgttgataaaatcctgcagacaggacaacttactaaggcagtttcagtaacatctgcagacggtaaaaaggcaacaataacggctggaaagtttggatataggtttaaggtggtgaagtaatggaatataaatttgacaaagaaaaatttaaagaaagcttcaatgcaaaggacaacgaaactaaatctgcggattcgtttcgtttaacacacaagccagacactcaattcaagctatatccatataaggcatctgggaaaactcaggcgccaattgtttacaacttggaagatgtcgtaactggtttttttagagaagcttctaacaaagtgacagcgccaatattattcgaagagttgtgtaataatctgatggatgatgttgatgttgctgatgaggacatggattatttcaaggatatgattcagagtttgttctttagagaatcagattttattgctgacaatctgggattatatccttatcaaacaacaacaaataacaagagcgcagataatcttgcacattttctttactctgtaatgggtattagtgaggaggattgcaaaaaaattgaagtggcaaaatctcaatatcagtttaatgttcttgaggacatggtgataaaaaatattgagagcaggaacgtatacgaagcagaaaagaaacaagcatatttcattgttaaagatgatatacaagaactatttaaagcagatttctcctatatgttggagtcaggaatgacttctcttgaggatttatcaaatctgtttgccgtatattatttttactatatttcacagacaagcgttattttagatcagttctgtacaggaaaaagagattctaaagttacgttatattatgcattggactgggaaaaagttagtaaaaaccgtcagtgttgtatagaaggatgggaaaagattcaagaaaatttaaatcacatgttcagccatgcaattacattagaaatattgaatcagacacaatcagatgaaatggttgattacatatccttagcgaaactagcaaacgaaccaggaatggattctgtgatagctgccgaagttaaaaaggccgaggaaacatattgctcttacgtgggagactataagggattcagtgatatacaatatccgttggctggtacagaaacagacaaagctgtaaatcatctgtttaaatgtgtctatcaacagttcttgaatacagatagaaaaagagcaaatcagttttacaatgaaaaatttacagagttttgtaagagcagatgggtgaagaacagaaagaaatctggacttgtacttaatcttactgaaagagatgtaatctttcttaccaagatatgtttaagggctgaaaaaaaaatcaggctaaatgatttgtttaaagagtatgaaaagagaggaatatatcttgacggtacttcaaaagagtacttgcaagaattctttacaaagttaaatctgattgataagaagagtgatagtggagatgcacagtatgttaaacgaattttatgattttattgcaaaaaaaataaatagtttctttcaggctgctgcagcagacggaactcttcttaaaggagagagcttctgtctgaagttggataacgaagaaatggtaacagaagttgctaatgctttagaagagctggcaacaagtaaccagtcaaagggagagtatgtttttccatgtggagatgggactctttataagacatatacacttaagcttattgatgatgaagtcattattgcagcacagataaatggaatgacaaatgattttttgtgtgccactttaagaaatgctgcgaatgagcagcagaagcctttgcttatgatttcggcaaatccaatcgatagtgccaagagtggatcacgagatatgtcagcgagtggaatgccattctatgctgagaatcttatgactgagattaggcaaatggttaatgatagcactcagcttacaaacacagaaaaaagaattctgagctttgagttaaccagaagagatgcagatgttttcagtgataaagcatctatttatgagtacaaagatcttttagcgattatgagcagtggaaaaattgaagtagataactttccgggatttcgtctgttcactgtcgatggaaaggtagaatatcagacttatagtaataatcaaatcgataaggaaataaagaataataatgaactgtttgagatgattgacaggagcattcgttatggaaatattgaggttgatttatcgagagtttttgagaataggtttattgatcgaattgagattgcacataaaaatgaaggagaaaactggagccgattatttacatatgctgagcttatagctgcaaaggaaaaatttttggataagattggtaatcctttaaagattgataatgagaacattttattctatggtgacatgccattaaatgttctcaatgccgatgaaaatctattgattcgtaatgagggatcacaaactgctaaaaagagaaataaaaacttcatagtatttaattcggaacattattctaaaattcatatgcaggtaacttgtaatgcgaaaattttaaatagtggaattgcagctgatgatacaacttacacgaaagagggaaaagacattatctttgaattcgaccgtgacggcgtatcctttcataagcttgaaataaaagatattacaaatgatataacatatctttttaaaatctgcattatagacatttcttcggaatatatgtatggcacggtaaaacataattttactatcgattataaaaagaataagaaaaacagtcgtataaaacttgtaggaataactgcaaatcttatttttaataagaatgcggaaaaactcagctcatgcaaactggaagacaacgaaatctatagttgtatgtatggagaaagactgctcatttactcttctgatgaggaactttcaaatttcggaagtggaattaatattgatataaactttgcgggaatagttgtaccttttgtactgtttcctgatgaagcaaagagttcagaaatcattggaagaaatatattacgagataaactttcgtctaaaaagagttttgaatttgatgatgatgcaatattgtcagattcacaggagttctttgcaaaagcaaatctcttaagagaattacgaattgaacaacagtttatagacggaaatattaaggccggagttgttcgcaatttctacacaacagaagcagttaaagtagaaaaaactgatttagatttatctgaagaacttgagactgcatatacagagatgcttgctacatttaagaatgctaagacgattccaaccttggcatatcttggtggagaattgcttgattcggtaaaaaaatatttgaaagcatttgaaaacatatttacaggattgtcagacggggaaaatttgactactcagcaggagaatgctttattacttggaacaattgaagtaggaagaaatactgatgaaatcttatttactccatttcatccattgaatcttaaatatcagctggcattattggaagagaatggtattgaatatgctacagacattgtattagatcgtctgaattctattaatttgttgccttatattcagagaactaaaagaatcttcaaggcttcagatcaactgtattcagaggagtggaaatattatgctccggttgaaaataaaaaatatcgtggaagtagaagatatgtaccgaagctggttgaggaaaaaatatccgagtttgtttctcattttagatacatatttgaagatattaataataaaacagtcaaaattaatttaataaacatgggcgactgcagcgaagtgtttatcggattggctcagtttttcatccatgcaatcaataaaaatgcagatgttgaaaagcttgtgcgttttgaacttcatatatatacagatgatataagggaaaatactttttcaaatcttcgtgaatatagtactttgaaggagtttttatctgagcagaagttggctgtgcgagcaggaacatcaatgaatagcttggagggtatactttcaacgaatgtagcatgctacttccataaggataatggcaagaattatgaatatgcgcatatttcattctatgagatggaatcagaaataacctctgaacaagctactatgaaccagattgagacaggaatttcgttagatggtattttatctggtattccttctagcaaatatggacataaatacagaaccggttatggaacaaaatatgctggaaagactgaacttgtaggtatggcatcactttataatgcgttaatgcaagttgagtcatcaggaaatccatatcaatcaggaacaagtatttcaactcagattgatgaaaaagctgaagacaagatggagtacatatacggaaactctaattgggttgtgttcgtagatccaaaggttgatttggatttctttagcgaaaaagaggccaagagcgatttacttattattcattatagtgatcaatatacgtctagtagtggatatgatgcaattacagttacccataaatctcagcagtattcaatggtcatccaggaatatttgaagattaaaggagtagaggcagatgtagatgatgttcatagaataataaatctgtttaatgccgtaaatggagattggttgcttaggctagtatcatcaaaaaaaggaagcaaggattctacatttagcagagaaaaaattagtatcgtagctgcaataaagtttatgctagcattccttaaacataaggacattgtttgggttccggtgtctcttgaagaaatgttaagagtttctgggggagcagggctatcaaaggatgaaggcgtattgtctgcaaagaaccttggatttgaaaaaggaccaacaagtgacgatttactttttatagggttggataagagtggtgatacaccaaaaatctatttatatcctacagaagtaaagaccggaaataacgaggttgcagttataaaaaaagcatttgaacaagcatctgcaactgctgaaggattacataaagcatttaatccgggcggagaaattatggacacaattttgtataaggttaatcgcaatttccttatgcaaatgctagttacaagctgtaaaaagatgcaggtatatcatgtagacgattctcagaattgggatgaagtattagatacttatcgagaagcaattttaaatgaaagatattttatgtctgagaatatccaggaattacttggaaaaggtgcagttttgtctttccgaaaagggttaatgtctcgaagaacatcttttaaggaagatgctattaattttatcgagatgcctgaacgggatgagttcggattgattctaaaacaagtggctgaaatttatgaagatattcattctaaacgagatagtgattttttgttgtttgatgaatgtatagtggataatttgacaggtgatttgagcaaattatcagtttcagcactagatgaaaaaactacattaaatgacacagagcaagatgttgataatacagatatatcttcaggaacgagcaatgatggaaaggaaatgcctgggacaacaccggatcctgaactaaattcaaatccagagccggatccgaagtcagaacctgaagatgaagaagatggtatgaacatattatttggattgaatgaacaaaatggtcagtccgtaatctggagaccaaatgatacaactcaattgttccatactaataccggaataattggaacgatgggaactggaaaaactcagtttacaaagtcacttatcacacagctgtatcgtgaacagattcacaatgttgatggcgaaagccttggaatattgatttttgactataagggtgattataacgaaagcaaaacagattttgttaatgcgacaaatgcaacaatattaaaaccttatcacttgccgtttaatcccctggcattggtaaaatcatcggtatttaagccactactaccgacacatacagcaaatgcttttaaggataccttatcaaaggtttataatcttgggccaaaacagcaagcaacattactgcaatgtattatggatgcatatactgtgagtggaataaatccgggaaatcctgctacgtgggatgaagaagcacctacatttgatcaagtatatcagagatatgcaaatgatgaagagataaagaagggggattcactagcagcagccttagacaagcttcatatgttccaggtttttgaagcaaatccgtccaatacaaaatcgttgtttgagattctgagtggtgtggttgtcatagatttatccggatatgatgcagatatacaaagcttgatagttgcaataacacttgatttgttttattcacaaatgcaagctgctggttcaagtaaaatggaaggaaactatagacaacttactaagatgattttggttgatgaagcagataactttatgcgtgagggattcccgtcacttaaaaagattttaaaagaaggtcgagagtttggtgtaggaacgatactttcaacacagtttctgaaacattttggaagtggagaggatgattattcaaaatacattcttacatgggtagttcataatgtttccgacctaaagaattctgatgttgattttgtgtttaaaacagaagctaagagtcaggaaaatcaagtgctctttaacgcaatcaaatcactagaaaaacatcatagtattgtgaagatgggaaatggaaagccggtttatgtaaaagataaagctttctgggaattatacaaagaatttaattgactggtataaaaacgaatgctatacttaagtagtatacttaagtatagcatttttgtattggaggaaacatggattacgcatacaaatttccggttgtaaggggcagtcaggcaggtagagagtactttatagcaatggtacctttgaagatgatttcaaagctgtttccgaatgaagaagagtatgtattaccagaatatagagctcagcgaaaattgaacgagtcaagaattcctgtaataagcaaatatattacagagaatcgtgattcatatgttttttctgcattagcagcatcgatagatggagagtttgaatttcatgaaagtagtgatggcatgggcacaggaattttagaagtatcaatggatgctagatttctgataaatgatggacaacaccgtaaagcagctatcttagatgcgttgaatgaggattcttcgttaggcaacgaaacaatatcggtagtattttatgaagatcagggattggcgagaagtcagcagatatttactgatttgaataagcatgctgttaaaacatcaaattctattgcggaattatatgattcgagagatgagttggcagtagtaaatagaaacgtaatagccaatgtcccttttttgaatgagtatacagataaggagaaggatatccttggtaagttttcttcaaatctttttacgctgaatacgttttataccgctaataaaagaattgttggtggatcagatatattcgaagatgcagagtcttttttgattaagtattggaagactgtagcagagaatgtagttcagtgggttgaattgtcaaaaagagaaatttctaaggttgacctaagggaaaactatattgttactcagggggtagtcattcaggcattcggcgttataggattgtacttctataaaaacccagaaattgatatcacgaaattcttatgcaatcttcaaaaaattgattggaaaagaagctcttctcagtggaagctgagagttataagggttgacggaaaaattataactagtaacaaggcaataaatcttacgtcaaatcaaatcaagaaggaaatcggattacctttatccgaggaagaagagcaaagagaacagcaattcttgagctcaataaacgtgtaggagaataataatcatggcagaaaaatgtgtgagctgtgaagcaaataagcagggcgtaaccattacaaaagagattatagatggcttaatggatacaataagaaaactgtatttatgtgatgacataccttgggttataggatattcaggaggaaaggacagtactgcaacattacagttggtgtggcttgctctttctgaactccctaaggatcaactaaagaaacaagtacatatcattaatacggatacaatggtggagtctccggttatttcaaaatgggttcaaacatcgttaaaaacaatggatgatgtggcagaagagcagggattgccttttgttactcacagattaactccagcaatagataacactttctgggtaaattttattggacgaggctatccatttccaaggaaaaagcttcgttggtgtactgacagattgaagattcagccggttaataattttgttaaggaaaaaattgctgaacatggcgaaattattatggttattggtacccgtaaggcagagagcgctcgaagagcgaaaactatggcatattacgagaagaaaagagttcgtgaattattaagtcctaatcaatctatggtgaatgaacttgtattttctccattagaggattggaatgacaatgatgtctgggtattcctgatgcagtataagaatccatggggatattcgaataaggacttactaacgctttatcgtggagctactgctgataatgaatgtccaatgatggttgagaagggattacctagttgtggtaagagtagatttggctgctgggtttgtacaatggtagaaaaagacaaatctatggaagcaatgattcaaaacgatgatgaaaaggcttggatgtctacattgcttgaatttagaaataagtttggcgatgaagaacatgatagagagagaagatcatttagaaaaatggctggatatcttcagggaagttataagcggcttcatcatggcccgtataagaaagaaatcagagaagaatggcttagagatttattagaaatccaaaagaatataaatgaaaatggtccagaagaatttcagaatttagaactaattacaattcctgaattgcgcaatatcagaagaatttgggttaatgataaacatgagtttgatgatacgttgcctagcatttatgaggatgtatttggaaagccattcgatgacccggaatggattgcgccagaggcatttaagaaagaagaatgggatattttaaaggatgtggtcgaggaattatatcctgatgaagaacttgcttttgaaatggcatatagcttgattgatattgagaatcgatctaatagtttaaatcagcgtaaaggtgtgatagactcattggaaaattgtattcagagaactttttataaaaatgaagatgatgctactgagtactatttgaatcaagtttcgagaaaaaaggatctcggtggaaagtacaacgaaaaagctcttgatagtagttatgatgaaccatcagaggacgatgaagatgaaatagacgaggaaaatgaataatgattatcaagcgattaacaatgcataattttggtgtgtatgcatctacgaacacccttgaattcaatggtaaaaagccagttgtcttaattggcggaatgaatgggcgaggaaagactactatccttgaggccgtactattgagtctttatggatcaaattcttttgcatacacagaaagcaagtatacaacttatggacagtatttgaagtcatatgtaaataaaacggatgggtctttggatacttttgtcgaaattgagtttgcgatggataagagtaatgatgagatttataccgtcagaagagactgggatggaaaaggccagagggtaaaagaaagaatcactgtactgaagaatggtgaggggaataaattcttaactgaaaactggcctatgtttgttgaaaatattttgcctagtgctttatctaattttttctttttcgatggagaaaaaattgctgagcttgcggttgaagaaactagcgagcagatgaaggaatctattaaagcaatgttaggtattactgtattagatgtacttcaaggtgatataggtaagataataaacaaaattagtaagaacatcgctgaaaaccaggatttaaagaaacttgaagagcttcgttctgttaaagaaacagctgaaaaggtattagaagaagcggacgttgagattgaaggtgcaaaactgcagttggaagagtcgcagttagaactggaacagcttaacactgaatattcagtaaaaggtggaggcattttggaacagaagaatgctttaatgaagcaaagaagtgaaagtatagctgccgttaatagtagccaggaacaattgctggaaattgcaggaggagagcttccacttctattagtttctgatcttttaaaggatattgggacacaaggaaaggctgaacaggagaaaaaaataaataaagtcgccttagaaaaagtgaatgttttatacgaaggatttgctggaaaatctgaagatgttgctaagttcattagctttatgaagacggaaattaattctgataaatcagaagaattgtataacctctcagattataacctgtaccagatagaactgcttaatgcagataaactaaagcgatgtgcattacatacacaggaattagtagctaaaagagataagaatcagaggaaggttgatgaggtagataatttgttgtcagtcgatatagatgagtcggtattaactgaactctttgagcagattaaagctaaagagcatgaggtgattgctaaacaggttgaaatagaggcattatgcaaggacagaacaactttacacggaaacttatttgcagccgaatctgagttcagtaaatatgcagagaagacactttctatattggaatcaatggatgcggatgaacgtactgttaaatatgcccatatggcagtacagattattaagctatatagaattcgcttgcaggaaagaaaaaccgacattttggctcaaacaatgaccgaatgctataagaagcttgctaacaaaaagaatcttgttgattgcataaagatggatcctgaaaccttagatttacagtatttgaatgctgatggcgaagaaattgcaaagaagcgactttcggcaggagaaaaacagttgatggtaatttcattgctttgggccttagctatttgttcaaagaaaaaattgccggtaataattgatactccattatctagacttgattcatctcatcgccaggccttgataaagacatattttcctaaggctagtgatcaaacaattatcttgtctacagattctgaaattgatgaaaactattacacaatgataaggaaaagcattggcgatgagtttactcttaaatataatgacaagactaaaaatacaacaatcaagccaggctattttggatgggaggcaaaactaaatgataattaaacagattaagttaacaaatgtctccaaggatcgtttgggtagactaaaaggcaaaactggaatcaaaaactggaatgttctttgtagatgggcgctttgctattctctttctgaaaatacaatgcctacagacattcagattgtagcagatagtaatgttgaaatgtcttggtataccttcggtggcgagtatagtgatatatatgatgcgattatgattgcatggtgtaaaaatatgggactaccaacggacgaagagactttggccaaatactttaagcttcatattgagcgtggtattgcacatttgtcaggtacgaattttattaagaacttagatgatttactagaccttgcaattgaggagaaataaatgggtatttacttagattataatgcatcagctccaatagattttcgagtgctggatgtgatggtagatgtatataagaatgcaatagggaacgcagatagcagaacacatgattatggtgacaatgcaaggaaagtagttgagaatgcaagaggtcaggtcgctagtttgcttggagttgagaacagtgaagtattttttacaagcgggtctacagaaagtaataacattgcaattcgaggcttaatagattatgcagaagaaagcggcaagaagcatgttataacaactagcattgaacataaagccgtattagaaacagctaagagtttgaagaaatatgggtttgatgtagatatagtggatccagaaactgacggaagaattaatgttgaaaaagtcagttcacttcttaaagaggatacacttctagttagcgttatgcatgcgaataatgagactggcgtaattcagccagtaaaagagcttggtgaattattagcagataagggaattctattccatattgacgctacacaaagctgcggaaaacttgtgcctgaattacgcgagataaaatataatatgctttctttaagcgcacataagctaagtggcccacaaggtgttggagcacttgtattaagaaagaaaagatataagcttccaccggttaaggcagttacttatggaggtcagcaggagcatggaattagaccgggaacaataccagtagctttagtcgctggattgggagaagcttgcaggcttgcagagacagaatatgaacagaatatagctgcttacaaagaaaagaaggatgcagtattagagcttatagaaaaatctggaattaagtatgaggtaaatggcaatcaggattactgcatgcctaatacaatcaacttgagtatcactggagttgagtctgaagccttgatgctgtcgtcgaagcaattctgtggtatatcaaatggctctgcatgtacctcacatgaatatagtccgagttatgttttgacggcaatgggactagatgcagatagaatttcatccgccataagaattagctggggagcgcatactgataaggatgagcttataaacgaactttcagaattaattgcggtagcaaagagtttagttttttagggagtaacacatggctggctggaatcttaaaagtggatcgataactgaatatgatgttagcgaagatagaatctggtctctgtttaactatgtgttctcgaattcgagtagaaaacgcaatacttataaatttggacttgtaaagtcgttattagataatgtttttaatggtcagcagaagtcagacggtatctattttacatatgaggagctgtttggacgttttgctgaaaactattggaatttggttatcaaatatgacttgaggcagatgagaccagatggaaaatccatgtattcgaaggttgaatctattttgaagcaagctgcggcagaaaatcagatacttgttaatcttgaatttgaggcaatagaagaaaagaaaaagcaacagattatcaagaaggtaactacagaatgcaaaaagtgcgttgtcggagccttatatgatgattttgacggagtaatttattcgtttgatatgaaagagtctggtctgatattaaattattgtatctatgattttatgctccggcataagtctgagctagagaaactcaattattattcatgggctagatttcttgagcaagtgaatgatgataatgcactgataagggtcattgataagcttgagcttgctacgccaaagagagaagatctttctgtttatagagagattctcaggagagagtttgaagaagacacatgcttttattgtggcaaaaaacttcaaaaagtgatccatgtagatcactttattccatggtcatttgtcaaagatgacaaaatctggaattttgttctttcatgtccaacttgtaatgaaaagaaaaataatagagtaccgggcaaggactacttgattcgcattgaagatagaaataagaaaattcagttgttgaataatacagtaatacaaacagattttgccgggtatagtgatgacttaattggcagaatgtggagctacgctaaactgagcggcattaaggaataccgaggaggaaaatgtagtattaagtataaaaaatcggaagcagttgagattgatttgaggtaaaagataacgatttatttgagaaaatgatacggaaagcgattgagaataaataggaaagtagcaggtatgataattatgaataagaacaatatgcatcagatatttgcacattatatagacaattttgaaatgcttaacaatgcggagcattcagaatattacaagtggcaagtatgccatgagttcagaccacttatggatgaggcacttgaagcagatgttgatgattttgcagatgcattatataaggtcaaggaatgcagtaagaatatcatagacagctatacacagccgttttatggtttggttaagtttgcacgggaagagccgtagactgttcagcaaatgtttatggatttgtattcggatgatggtggaaacgttaagaaacagatggaacttattcagaatttctttatccagagcaatgaactgctggaaaaatactacccaaacagtcatctttacaagcagaattcacattctgtgtcatcatatctttttctttatgatcccgaccatcattatatgtataaagcaacccagtcacaggcaatggcagactgtatagaattttatgatgactggggtaccggtgacaatataaaactggatgtttattaccacatgtgtgatgaaatccttgctgaaatgaaaaactgtcctgaattactggcaacgaacaggagcagatatgatggagcactgcgtttggctccgggagagttacattcggatgaagaactgcacattttgctgtttgatattatctattgctgtaatgtatatgacctgtttgatggaatatcgttttcaaagccaaaatcaaaggaaaaacagcttatcttagagaagaaaaacagctagaattttgaaagatgagtatgatgaagcaaaaaggaatgtcgatgcattaaatgaagcagttcagtattttattgaaagcgtgaagacagccggacagattatacataagaaatttggaatatgtaacgtgctatcagtcgattcaaagtacatatatcttaagattcagagcacaggcgaagaaaggcagcttggatttatagttgttgtagcgaatggtattataagggtggattccaaggaatttgatgtaaagaggaatgaatatctggatatgcttaaaaacgctgacagtatacctcgaaagctggagtatgcagcacacgcactggaaccttatgaggaatatctggagtaggagactgatttatggggaatttatatgaattgttgtgctatgtatagctgtgagatggaagtggattttaatgactaaggaagaatggtataaacagctctttgaacatcttgaagcctcaaagtttaggagcagttttcatttgaaacaaaaggatattgattacatcaatgaaaaaggattagaagtgataagacagcacgcacaggattttattgcaaagcgtgaagctccggcagttattccgaatgatggaaagcagacacctactaagggacatccggtatttattgcacaacatgcaacggcaacctgttgtcgggaatgcatcagaaaatggcataagatgcagccgggcagagaactcagtcagatacagcaggattatcttgttgatgtaattatgacatggatagaaaaggagcttacaagggagaaggagaattgatttatacactcatggaaaaggaggtgccatatgccatttaagattgtacgaaacgatataacaaaggtaaaggcagatgttattgtcaatactgctaatccaaatccgatatgtgcaagtggcacggatctggcaatctatgaggcggtcggaaagaaacaggtccttgcagaacgtcaaaagattggcaaaattgcgagaggagacgttgctgttaccagagcatatcagctgcaggcaaaatatatcatacatactgtaggtccaatatgggaagatggaacacatcatgaatttgaaattctggagagctgttacaggaagtccctgcaaaaagctgttgaattgaaatgtgagagcattgcatttcctttgatttcaaccggagtgtatggttttccaaaggataaggcattacagatagcagtatccgtattcagtgagttccttacaaaaaatgaaatgcaaatcattcttgtggtgtttgacaagaaatcatttcagttatctggacagatagttggcgagatagattcctatatagatgccaattatgtcaggacaagtcataagaaggaatatccgatagaaagtcggggacgagccagaagcagacatataccggaagaagaactatatgagcaaatgctccgcagtgaggactctgaggaaagttacccatttgatgaagaatcggatgctgatgtcaggttgacggaaccatgtatgctgtcatctgatatgtcattggaagatcagcttgcaaatatgggagcatcttttcacgaaaagctgtttgacctgatagcagcagcgggtattgtcaacaaggatgtctggaaaaatgcaaaccttgaccggaagcacttttcaaagattcagtgtgatgagcattatcatccaaagaaaaagacggtaatggctttgtgtatcgcacttcatctcgatctggagcaggcaaaggatttgatggcaagggcagactgggcattcagtccgagcagtaagttggacctgattgtgcagaaagcgattattgataagcagaatgatatcatgcagctgaatgtgacattgtttaagtatacaaatgagatattaggtgtataagaaatagaaatgttttttgatagatatttgaatattgtgtgaaaaggtaaggaggtaatttatttggatattgttgagaaaaagaaatctcatgattttaatatttattatttgaattttagtaaggtatatgaaattgcgatgatgattaacaatgttatacttactaaaatcgaaacagataaatcaaatagctttgaggaacagtatggttttacatcgtctatttctgcacaaggtaccaaacagtttcttgatggaataaaggcgtctatttcagctgatacaagggaaacatctacatcgtcttcaaaagtagtggaaagtttggatgtaaagacaaccaaatcaattcttttacgtaggattattgaacaatgtgcacctattactgtattagaaaatttgacagagggcgatcttgtaaaagtagacagagtaaaattagaattattgaatgaggagagcctcaggcaatttcttattttacgtcgtgacgcattaaagggaatgcgagtagagggaatggaaattaacaacttagtcagctctatgttacaagactatgcatatattttgaaagggcgtgtttatgatgaaagcctgaaagagcctgtttcagaaataataattaagattccaatggaaattcaatctgaatttgaaaataagtataacataaatgatttacttattggtcatgtatctatagttggaatatataaaggtattgtaggggaagaatttattacatcaaatacattcacatattttcaagaagtaggagcacgtaaggaaaagcaagaagaaacggtcaataaaataataaaaagtaatggtgaatcggtgtcatacgataatataatgaaaaagaaagataacgattatcattttgttgatactcttgcaataattcaagatgttgcattcaaactggaagatataccagcacgtaaacgtactttgtgggaacgtttttgtatttggttaaggaagcaacggaggaactaattatggggtatgcattgtttgcttatcggaatttggaagaattgaggaaaattcaagaagaaagagaagtgatcccttttatatttgataagacaaaaaatgtacttgatacatattctgatatttgtattgatatatctgcattgatatatttactgataacaagtagaagtagtatagaatatgcatatgtcaatttagctagtattgatgatgatactgttgtaattgtagaagaaaacattgctaaaaacgctgtagaattattgccgcttttgttttctaattataaattttattacgaggaagataatgaagatgattatagcgacgaggaaacacgtgaatttgagtcatgttgcagaaaaaagatatacagatacaataatgtagaggaattggatagaataattttctatgcaaaaattaatgatattccgattgcaactttttctcaggcaaatggcgaactacgaaaggagtttgaacaatttaataagtcttctgaagaggcattattagacttaacttctgtatcatacgcacttgaagataataaaacattgatttatgcacttgagcaatttctagccattatgcccaatattagaattatagcccaaacagttcggatcgatgtacttttaagatattttccattatttttagaaggtcaagagtctataggtaagctgtttccagatttatcagatattggagtagatgagcaagaaggaaatactttaaaaaaagttacagattttagtaaagaagactttgatgcatttatagatgcatttaatcataatctaataggacataattattttaaaaatagattacagtatattcttagaaattttatatgtttaaataaagcaaaagaacagaaggttttgtcgatttttttgtttggagcatctggaattggaaaaacagaggtagcaagattgatggcaaatggactccaaagtgattgttacttagctaaaattaattttcaaaattatagtagtcaagatgcattaaatagtttgattggaagtcctgcaggatatgttggatgcaactatggggaattgagtgaaaaagtcaaaaaaagcaaggtgggaatactgctttgtgatgaatttgaaaaaactactcgtccggtatattcattttttttagaattgttagaagaaggtcattttacagactccatggctcgagagtatgatatggacggctatgttataatttttacttctaatcttcttagtgaggcagaatataaaaaagaaataccacctgaactccagactcgttttgacttggtatgtgaatttgagaaaccggaaatgtcagagaagatagcttttcttgaattactcttggagaaagcaagaaataagtattcagaacaatttgcaagaattgaaatgactgagcaagagaagacgcaattattcgattttgattatgcatctctttcagcgttgagagatattaaacgtatatttaataatcgtttaatggattattttatagaaaagggagttatgtaataagaatatagtaagcgctcttcaagattttatgctttaaaagtaggcttcattactatatttcgtgcctattataatatataaaagcgaaaaaaagcaacaaaattctgtttgacttttttcaaatcaatcaatataataattcctgaacgagtagcagactagcgtaaatccagttatgttactcgtttttttattttaaagttaatagaacgacatgaaaaaagtgtgtagcctatcagcgtaagtccagcttattgtgataggaacacactttttttgtgccgcaaaacaaggaggaaaaacaaggaggatagtatgtcagaaagtaacaaaatgaaggagatgccggtcaataagctcatggtacagatgggaataccgatgatcttatcgatggcattgcaggcggtctacaacattgtggacagtgcctttgttggaaacatgaaggtgggaagtgaagcggcgcttaacgcactgacactggtgttcccggtacagatgcttatggtggcagtaggaattggaacgggtgtcggaaccaatgcgcttctcgcaaggacactcggacagggaaatgccaaaaaagctgcaaaagtggcgggcaacagtttatttctcggagaaattatttatgtggtatgtttcttatttggaatttttggagtaagagcatacatttcatcacagaccattgatccggaagtgatttcaatgggaatgagttatttaagaatatgctgtgtggtttcatttggaatcattttcttctcattatttgaaaaattattacaggcgaccggacgttccctttattctacgatcggtcaggtggtaggtgcggtcgtaaatataattctagatccgatcatgatttacggtatcggaccggttcctgaaatgggcgtggagggcgcagcctatgctactgtaattggtcaggtcgcatcggcagcattattatttatttttcatatgaaattaaataaagagtttgagcatggtgtgggatacatgaagcctgataccggaattataaaagaaatctatgcgatcggacttccggcgatcattgcacaggcgttgatgtctatcatggtttatgtgatgaatctgatcttaaaattcagtccttctgcacagaccgcatatggattgttctataaagtgcagcagtttgtattgttcctcgcatttggactcagggatgcaatcacgccgatcattgcgtttgcctacggaatgcacagcaaaaagaggattcaggacggaatcaggtatggactgatttatacgatcgtacttatggtcgttggtgtggcgatcacggaaattttcccaggtgcttttgcgacgttatttaatgcgggacaatccagagagtatttcatcggagcgatgagaatcatctccatcagctttatttttgcgggaatcaatgtggcatatcagggaatttatcaggcactggacggtggtatggaatcacttgtgatctcgctgctcagacagcttataattatattaccgctggccggcattttctctgtttttgtcagaaacggtcagatgggagtttcgttgatctggtgggcatttccgatcaccgagcttaccgcatgtctggtgggatatgtattgttgaagaggatcagaaaaaacaaggtagaaagtttaagttaaggaggagtcagttatggaaaagagaatcataacgatcagcagagagtttggaagcggcggccgctttatcggtgaagaagtggcaaagaaacttggaatttcctattatgacaaggatatcatcggacagattgcagagcagtcaggatttgcaccggaatatatccgggaaaatgcggaattgtctccgaagaaaggcttatttgcctatgcattttccggacgtgatatcacagggaaatcagtggaagatatggtgtatgaagcacagagaaacgtgatcctgaaaattgcggaaaaagaaagctgtgtgatcataggaagaaatgcggattttatcttaaaagaccgggaggatgtgctgaatgtttttatacatggggatatgccgaaaaaagtgcagcgtatctgtaaactatacaatgtcgcagaagctgatgctgcaaaaatgataaccgaaacagataaaaggcgcagaacaaactataatttctacacagaccagaaatggggaatggcaagtaattattcattgtccttgaacagttcgcaactgggatatgagaggtgtgaggaaatcattttggagtgtgtaaaatagagaatagtatggatcaataaaaaaagaactggtttttgaggtgtcccctcaaaaaccagttctttttttatgatgtctgaaattctgttaaattaacacttctcaggttccggataatcaaccccgaaagtttcaactgtcacggttttcattacctgtggctgtaatggacggtcagagtaatcagttgctgtttctgcaattttattgacaacatccataccatcgatcactttaccgaatgcagcataagcaccgtctaagtgtggagagttcttgtgcatgatgaaaaactgggaaccggcagaatccgggatcatagttcttgccatggataaaacaccttcagaatgttttaagtcatttttgaaaccgttctgggaaaattctcctttgatttcatagcccgggccacccattccggttccgtccgggtcgccgccctggatcataaaaccgttgatgacacggtggaagatgacaccgtcataaaaacctttttttactaaactgataaagttgtttacagtatttggtgcgatttcaggataaagctctgctttcatgatatcgccgttttccatctcgattgtaacaattggatttgacataataattgattcctttcattgaatatgatatcgtaatttttcatatacacaccatattgtaacgaaaaaatatgttttcgtaaagataaaacgcaaaaaatcagatcgttgtattctgaaagcagactctgatcttttgtgcaatgccggcatcaataaagcctttgtctgccatatcatcgagaatatcgcaggttttttcatgcgaaaaaccctgtttataagggcggctttcggtgagtgcctgataaatgtctatacacgccataatgcgttccggctcgtttaattcggcggcagttttgccgaaaggatagccttttccgttcagtttttcgtggtggaatgcagcccagtcacggatgtcttcaaaatcgttgatattggacagaatcagataagtatatcctgcatggtttttcatttttgaaaattcttcatcggtcagcttatccggtttttccaaaatatcattgtcgattgccattttgccgatatcatgaagtgcgccggccagatacattttctggacctgtgtgggatcgtagccgttgtacgctgcaaatgcggcggctttctctgcaacaccaatggagtgtctgcttgtaaaagaagatttatagtcgacgatctgcgcaaaaaagtcggcgatatttttgcaggtttcccagtcaaaggtctgtttttctctcggaacgatctcccagagtttcgtttcaaaggagtcatccctcaaagctgcaaattcgttatctgaaaatatatggaaaaaagcatccacacatgcggcgtcaaaaagtttatccgtatgccggatcaggtactgttttaccatatcccatctctgtgtttcaaatgcaccgctgtgcccgatgatatccaccacatcggcaaggtggataatgcgcgcagacagaggaacttcatcccattttttgtgaaatggcccggtgccgtccgcgtgctcatgatggtataggattgcattggtaacgtcagttttaaaagggatttttgcaagattctgttcgccgtagatgcaatgcaggttcgtagtgtttgccacaaggtcagcggtcaggtctgccgcggaatgctcctgcaattcctcggaaatatattgtgtgagggcgttgtcgtgcaacagagcgcagattgcgagatcctgcagggcatcctccggcagatcaaaatactgccccatgcgcacactgatataggccactcgttttccgtgtttatttttaatgtttaccagttctgcctcgatgcagtcgagagcataggaacaggcactgatcaaaccgataatatctatctccatgatttattttaatgaaatcagaccgcttataaagcgatatatccagatttcatcaacctccttaaaatagtaatgattcctattattggattataaaatcagttttccatattgtcaatatgttacagttcacaggttaccctgcgaactgtaacttcgcagccccatataaagttttgcttcgcaaaagggggctgctcacacccgcatcacgttcatacgcacctgaacagcatggtgttcaggtgctgagtgaacagtaacgtcaatattcgttacagtattcatatgaccatgattagttttagcaggaatagcagaagtttcatatttataggaagtatatcgaaaaacttccttgtaaatttttttgttttatggtttgataagtacagaaaaagagtatcggagaacaaaggagagaaaaagtatgccagtttttgatttcagcagcgcttcagaggaaaaagaggcgtttgtatgtacatataccgcatttacatcagacagttccgaaaaaacaccggatgatccgatcctggtgttagacaatcggcaaaaacagtggagccatcattccaccggagtattttgcaaccaaagccagtggacagcatttgagtttaaggaggaggacgagacatttcgttccaatatcctgcggatcgatgcacgttttgtgaatctgatcaaatggcttggggagaaccatatcaacgttcttttgtccggggaaaacagggcagatggctatgctgtgtacaagatcagggaaaatgcttttcatggcggcacgaaactttccgcagcggatggatttttgcagtatgtgatggagcgccttttatcgagcagtgcaccggagcaggaggatgaggacgaagagttagacgagagcggcgacagcatgaagcttaccagtatccagagtatttcggatttcttaaactgcgcaggaagaaccatgccggacaatatcagactgtgggcgagaagaaatttagcagttgcacgttccagcgaagtgtctgccgaggaacgccgccacgcgcagcgtgcactttccattatgacgaatatccagtggaaaaataattattttgaagcaatcgatccggtggaagcgcgcaggattttagatgaagaactatacggaatggaaaaagtaaaacagcgtatcatggaaactatcatccagatcaaccgcacacacacacttccagcgtatggacttctgcttgtcggaccggcaggaaccggaaaatcacagattgcctatgcggtggcaagaattttaaaactgccgtggacgacacttgatatgagttccatcaatgacccggagcagctgaccggaagttcccgtatctacggaaatgcaaagccgggtattattatggatgcattttccatggctggcgagtcgaaccttgtattcatcatcaacgagcttgataaggctgcatccggaaaaggaaacggcaatccggcggacgtacttcttaccttattagataatcttggatttacagacaactatatggaatgtatgattccgaccggcggtgtctatccgattgcaactgccaatgtaaaagaagatatcagcgccccgctgatgtcacgttttgcagtgatcgatatcccggattatacgcaggaagagaaaaaaatcattttctccaaatttgcactgccaaaagtattaaagagaatcggattgctgcagggcgagatcgttctgaccggggagggactggatgaactgatcgagcagtataagaatacatcgggaatccgtgatctggagcaggcggcagagcacctagcagccaatgcactgtatcagattgaagtagaccatgtaaaacaggttgtgtttgatgcggaaatggtaaaaaaattatttgcgtaaaaaacaaaatataagaaaggtaaaaagaccacttcatgaaatttttcgtgaggtggtcttttactgtccgaattaatggacagaaaatatggataatgggaagcagcaagagggcaaaatgacggaaagtgaggagcatggcagatgaaaacggaatatcagattattgcggtagactttgacggaacactttgtacggactgcttcccaaagatcggacagccgaatacagcactgatcgaactgctgaaaggattgagaaggcagggacgccagattattttgtggacgtgccgctgtggaaatcagttagaggaagcagtggaatggtgcaggaagtgggaactggaatttgatacagtgaatgagaatctgccggagattatcgaaaggtacggatcagacggaagaaagatttatgcggatgtttatattgatgacaaaagctgttttccatgggaggtaaaaaaggatgagaaagttggattatgaatttatttttacatgcggtattgttgcatttatcgcagcgcttggaatggtagctggcattgttgtgctggctggggcaaagatttatgtttataacctgcctttgatcgtgggaagctttctggctatcggaggacttttgtggggattattgttagttttgaacaatgataaggtggaaaaaaggacaaaacatcgttactgctcagacagtatctgagcactttgctgtatcatacatatttagtaactattcagcacctcattcgcaaaatcgctctttcagagctatatttttgctcatgtggttacttcgccaaagaaattttcaaaattatgctcattcatgcaagcatgattcgcaaatttatgaaaattgtcttggctctgaatagttactatatttaccagattaaggttgacgctctatcgtgaattaaatataataaacttgatttactgtgcctttttaggggaataccgaaggcatctggaggaaaaatgagaagaaaccttaatataaaacagagaaaatggcggagctttatctttgcaacgatttttggtgtgacagcagcgactgcggtcattacggtaaaaccgttggaaagttatgcgtatacggagacggcgggtgttttgaatgatggaccggtacagatgcgaaagactccggtagatggggacaagatcacatctttagctgcgggtacagcagtccgtgtgatagatgaagtggatggctccgatggaatgaaatggtacaaggtacagatttcctataatggaatggcatccaccggatatatccggtcagattttatcacgctttcaacagaagatacttcttccggaagtacgatcacagataattcagcacagggtgcagccggagttgtcacgaacaccaatggcaacgtttacgtgagaaccggagcaagcacggcatattcgccggtgaccatggtaaaaagagaccagacggtgaatgtgctgggacagacaacgacgaatgggacaatctggtataatgtgacgtttaataaagatggggtggattatgccgggtggatctgtggaacataccttgcggtaacaggacagacttctgcggacggatcgcagggagctgctacaacagtgacagatgaagaatatgttgcatcgttaaaatcagcaggatttccggacagctattgtaactcacttctggcattgcaccagaagtatccagactggcagttcgttccggtacagacaggactggactggaataccgtcattgcaaatgagagcgtagtcggaaggaatctggtgcagagttcttccaatgatgcaagaaaatccacagaggcaggagcctacgactgggcaacaaatagctggtatggttatgatggaaaaagctgggtgagtgcttcttccaactacatagcatattgcatggatccgagaaattacctgaatgacacgtatatttttcagtttgaaacgttagaatatgcgccatatcagaacgtgacaggagttggaaatattctgtcaggcagttttatgagtggaaactatagcgatacagacggagcatcgcgaagctatgcagatactttcatggaagtgggacagaacttgagtgtcagtccttatcatctggctgcaagatgtaggcaggagcagggaaataaggggacaagtcctttgatctctggcaattactctggctataatggatattacaattactttaatatcggagcatatacgacatcgtctgcgtctgcgacggtcaacggattgatttatgcgaaaaataacgactggaattctatttataaatcaattaatggtggagctggtatcgttggaaataattatgtgaaaaaagggcagaacaccttatatttccagaaatttaatgtggtgaatatgaacagcatatactcacatcagtacatgacaaatgtgcaggcggcaatgtcagaaggaaaaacaatgagcaccgcttatgcggataaatcacagggatttatattccgtattccggtgtatagcaatatgccggagtcagcagtgacgttttcagacagtggtaatccgaataactggctctcttctctcagcgtaagcggatatggactgacaccgtctttccaggcagcagtaaccgattattccgtgatcgttggaaccgaggtaagctcgatcaatgtaggtgcttcggcagttgcaccgaaagcgggagtttccggggcgggaacttatgcattgaattatggaaataatgcgatcaacgtaacttgtgtgtcacagagcggttcggcaaaaacctacacgatcaatgtggtaagacagcagccggcagcagacaatacccagacaccggaaagtggtggaacaacggttgcggacggcgtatccgtttctacctcctataaactgggagataccgtgatcacaggtattacaccgggaacaggcgcttcttctgtacttgccaatatctcagcgggaagcggcacggtcaaagtgctgaaagcagatggcacagaaaataccggtgcagtcggaacaggtaataaaattgcagtatatgcaaatggaacactggtgaagcagtatgacgttgtcatttacggtgacatcaatggagatggaaaaatctctgtggtcgatctggtcatgatgcagaaacagattcttggaacatcacagctttccggtgcgtatgcagcggctgcggacataagcagagatggaaaagtttccgtaaaagaccttgtgcttttgcagaaacatattataaatgcagcacagattgaacagtaacagggctgtgtggatagaaagagttattttagtgagaaaatacaattttcacacataagaatggagagtaaaatgaaaaagaaattaggtgtgatcattacactgttaacattatgcatctgccttatgacaccgcagatgcatgccaaggcggcttccggaaaaacaacgatcgctgtgtctgccagttccctgaatatcggacagactgtgacggtaacggcaaaagcattaagtgcatccggggacagtgcatatgccaatatggttttgacctatgatgccggcattctggagtttgtgagctgtaatgcaacttatggcggtggcggcggaagtatttcggtagcgagtgacagcttcagtgtgacattaaaagcaattgctgcagggaaagcatccatatccctttctgctacagatggagttattttcagcaccgcggaagaattggattccatggcaggcagcagcacttctgtgacggtcaaaaacgaagcagcaggcagcaacacaggaaataacagcagtgccggtaacaacggaagctccggcagcaatggaaatgtgggaaatggaagcagttctggcacaggaagtaacaacaatactggaagtaatacgaatacggcagctttatccgcagataattccttaaaagcactgacaatctcaccgggaacattgtctccggcttttaagggaagtacaacaaagtatacggcagctgtggataattctgtgacaagcattgcggtcagtgcaacgcctgtaaatgaaaaggcaaccgttgaatcggttaccggaaacacgaatcttgccgtcggagcgaatgttgtgaagattgttgtaaaggcagaaaacggaacaacagccacttataaaatcactgtgacaagacaggctgcaggaaccaccggaagtgagacgacaactacaggcggtgaaaacggagacgacggaaatggtgacagcgagactccagaagatactgaggaagtggacacaacggaaactccggtatcagcggcagatgttgtgatcaataacacgacctaccatatcgcagacaattttacagaggaacagattccggctgattttacagaagcaacagttaatttccgtggaacggaatgcagaggtctgacgtttgacaaaggaacaatttctctgatctatctggaaacagacaatgtggacgcaacgaccggcagattctttatttatgatgagaccagggatgttgtctatgattttatgaagtttactgcaggtgagagcagttatgtgattccacttttagcaccgcttgattcggtattgccggacagctatgtgcaggtgtctttgcagatgccggaaagcacggtaatgacggcgtatcagcttccggcagcagagggagaggaagcttcggacttttatgtgttttatgcagtaaatcaggacggaaccgagggctggtatcagtatgatgcggcagaaggtacttaccagcgtgtcaatggaaatatcaccgagacagcagattcttcttcggatgaccttgcggcattgcagagtgagtatgatgaactctcaaagaaatataaagatgcaaaatccttttccagaaacatgatcgctgtgattatttttgtattggcgatcgcagttgtggtcatactgaatatcatgctctttggcaggaagaaaaaaggaaaagacgaactctcagaggacaacgatccggagcttgacgagccagagaacgaggacgacgaagcaaacgaagagacagaaaccgagaaaaaacctttcttgggaaaattccatggattccgaaaaaaagaaaaaaatgaggatgaggacgattatttcgatgacgaggaagagtacatcgaggaagaacatccaatcaacagggcttaccgcgaatggaatgattatgaggatgaaattccatccacttctgagaaatcagtgacagaagaaaagtccgagaaaaaatcatctacagaaaatgaaaaaatggatgtgccgcaaaaaaatgaaacttctgtgaaaaatgaaaaaggaatggaagttttcgacctaaatgatttataatataaaatagaatgtaggtaattgcgaaaatcattcataacgtaaattaaattgtgaaaaatcaacaaaagcttgagaaaacactggggaaccgccggtacttagaaggcaggtgcgacattttttatcaggtctgtgcatttactgcacagaccgtgcgaagatgattcaagagtgagcaaattcctatctgcgaagcagattttaaatgaatttgcgaagtactgcgaagaatgagcagtaccgttgcgagtgacacgtagcggaagcgtgttttcgaaaattttgttgattttgaacaatttgaaatagcttaaggagagtttgcaatcacctaataaataatgtgaggagacaacatgcaattaccatacactgtaaaagcaaaaaaagcggttacgatcgccggcaaaatgtcaaaatcattacatcataattatatcggaaccgagcacttactgattgggctattgaaggaaaattcaggagtagcggcaaaaattctgaatgagaatggtgtagagttagataaaattgtagatctgatcaaagaattgatcgctccggcagagggaacagcagtagcagaatcagatggttattcaccgagagcagcaaaagttcttgagaatgcagagaaggaggcagtcagattccatgcagatgccattggaacagaacatattctgattgccatgatcaaagagacagactgtgttgcatccagattactgacaacgctgtccgtcaatatgcagaaagtctttgtggacactctcattgcgatgggggaagatgcaaatctttaccgcgaagaatttcagaatggccgtccgggaaaaaagaaaaataatgagggaaccccgacgctggatcagtattccagagatctgacacagcttgcaacggaaggagcactggatccggtggttggacgtgaggaagaaatccagagagtgattcagattctaagcagaagaacgaagaacaatccatgtctgatcggagaaccgggagttggtaaaacggctatcgtggaaggaatcgcagagcgtatcgtatccggccttgtaccggactctgttcagggaaaaagagtggtatctttagacctatccggtattgtggctggttcaaaataccgcggtgaatttgaagagcgtatcaaaaaagtgattcaggaagtgacaaaagcaggaaatgttttgctgtttatcgatgagcttcacacaatcatcggtgccggtggcgcagagggcgcgattgatgcctctaatattttaaaacctgcacttgcccgtggtgagattcagatcatgggagcaacgacaatcacagaataccgcaaatatgtagaaaaagatgctgcactagagcgaagattccagcctgtgacggtggaggaaccgggcgaggaacagacagttgcaattttgaaagggcttcgcggtaaatacgaagcacatcatcatgtaaagatcacggatgaggcagtcgaggcggcagtccgcctgtcagcgcgctatatcaatgaccgttttttgccggataaggcaattgatctgatggatgaagcagcagcaagagtgcggtttggcgtgtctaaccatacagagaaacttgcggaattgagaaatcagatcacagaaaaagaattacagttagaggatgctctgagcaattccgatattgcgcttgcaaaacagtgcaaggaagaaaaagaagcattggaagcagagcttgagaagcagacaaaaaaagcgcagcgtgagatccgcagaaagaatctgtctgtcacagaggatgatgtggcagatgttgtttccggctggacaaaaattccggtgaagaaactggcagaaggcgaggcagcccgcctgaaaaaattagaggcaacgctgcacaaacgtgtcgttggtcaggaagaagctgtgacggcggtggcaaaagcggtgagacgtggacgtgtcggtttaaaagatccgagaagaccaatcggttcgttcctgttcttaggacctacaggcgtaggtaaaacggagatttccaaggcactggcggaggctgttttcggcaatgaacaggcgatgatccgcgtggatatgtcggagtacatggagaaacacagtgtttctaaaatgatcggttccccgccgggatatgtcggacatgaggacggcggtcagctcagcgagaaagtgcgcaggaatccgtattccgtgattttgtttgacgagatcgaaaaagcgcatccggatgtatttaatattttactccaggtgttagacgatggacatatcacggattcccagggacgcaaggtggactttaaaaatacgatcattatcatgacatcaaatgcaggagcacagtccatagtggagccgaaaaaactaggttttgcatcttcggatgatgaaaagcagaattacgagcgcatgaaaaacagtgtgatggaggaagtgcgcagaattttcaaaccggagttcttaaaccgtattgatgagaccatcgtattccgttcactgaacaaaaatgatatgaaacagatcgtcacattaatgttgaaagatctgacagaccgttgtaagagccagatggatatcacacttcatgtgcgtgacagcgtgaaaaattatattgtggaaaaagcatacgaaccgaaatatggcgcaagaccactccgccgcaagatccagaatgagattgaggatcagcttgcagaagaaatcttagacggcaaggtgaaaaagggtgatgaagtgatcgtcactacgaaaaagaatgcagttgtttttgaagtaaaggaacagtaacacaaaaataaaaaaatccttaaaaatgatgaaaatgctggcaatcgaaatgtagttgagctataatgattttacaaaatttttacggtgcagcaggcagagaaggactgtaccacaggaggaaaagatgagcgctattagtgaattaattcgttcagaagcagatggaacgatcagttttggagattacactctggatgcaaaggcaaagcttgataacttcgggcatcagggagatctttataaggtaaaaacttacaaagacatcaccaagctggagcgtaatggtatgtttgtttatgaatccgtaccgggaacagcggcatatcatttgaatgcaacggacacaggaatttctttttccgtggaaggaccggaagatgctcagatcacactggagttagaagaagagactgagtatgaaattacagtggacggagcaagcgcaggtaagatgaaaacaaatctcggtggcaagttgaccgtcagtgtggaacttggagagaaaccggtagaagttcagattcagaaatgctaagaaatgataaggggttgtcagaaacggcaactccttttaatgtcaatcggaactatttgcagagtttccggttatttttttgatagggaaggttatatggcaaaaggaaaaacaagtatttttttctgccagtcctgcggatacgaatcgtccaaatggatggggcagtgtccgggatgtaaggaatggaatacatttgtagaagaagtggtggacaaaaagagtgcgggcacactggcaaagcagaaagcgacagcgtcagaggcaaaggtactgcctctgtcccagatcgagatgacctatgacaagcgtgtgtcaacagacatgaaagaattagaccgtgtacttggcggcggtattgtgcagggttccatggtgttagtgggaggtgatcccggaatcggaaaatccacattgctgcttcaggtctgcaggaatctgtcggagcataacataaaagtgctctatatttccggggaggaatctttgcagcagatcaaaatccgtgcggagcgcatcggaaatttcggggacagtctgaaactgctgtgtgagacaaatcttgacaccataaaggcagtcattgaccgggaaaaaccgcagatcgttgtaatcgattccatccagacgatgtttaacgaagaggtttcctcggcaccgggcagtgtatcacaggtgcgcgagtccacaggtgttttgatgcagatcgcaaagggaatgggaatctccattttcattgtgggacatgtgacgaaagagggagtggtggcaggaccgagggtgttagaacacatggtagacaccgtgctttattttgagggagacaggcatgcggcttaccgtattttaagaggtgtaaaaaaccgttttggctccacaaatgagatcggtgtgttcgagatgcggcaggatggtcttgtggaagtggaaaatccgtctgaatatatgttgagcggcaagccggagggagcgtctggctctgttgtggcatgttccatggaagggactagaccaatccttttggaggtgcaggcacttgtatgtcacagtaattttggtattccgcgaagaacagcggcaggaacggattttaaccgtgtcaatcttttgatggcggttctggaaaaaagactgggcttaaagctgggtgactgtgatgcctatgtgaatatcgcaggaggaatcaaaatgaatgagccggcaatcgaccttggcattgttcttgcattgatctcaagttacaaggacaaaccgatcgatgagaaaaccatctgttttggcgaggtcggattaagcggtgaggtccgcgcggtaaatatggcagaacagcgggtgcaggaggcaaaaaaacttggctttgaggtctgtattctaccggaggtctgcagaaaatccatgacagaagtaaaaggtatcaagctggtcggtgtgagcaatcttttagatgccatgaattatctgaaataaaaaaattgtatgaattttataaaaaataaaggaaattgaaaaatcctgccgaataataaaaatatggagattctattgaaacgattttttatatggtgcttcgggagagactgtcagatatcagagaggtgatacatatgacaatacgggaagaacttgaaaaaatggagcgggaaacattaagcccttatgcaacgctcagtgtgaacacgaaaggcagggaacgcgaggaagaacagtgcgatgtccggcctgtttttcagcgagacagggacagaatcctgcattgtaaggcattccggcggttgaagaataagacacaggtttttctgacaccgaagggagatcactataggacaagactttcccataccttagaggtatcgcagaatgcgagaacaattgcaaaagcactgcgtctgaatgaagatttggtggaagcaatcgcattgggacacgatatggggcatacgccgtttggccatgccggagagtatgtgttaaacgaaatctgtgaagacggattccggcacaacgagcagagtgtccgtatcgtggaaaaacttgagaaaaacggcatgggcttaaatctgacttgggaagtgcgggacggtattttaaatcatcagtctaagtcaatgccacatacgctggagggaaaagtagtccgtttatcagataaaatcgcctatgtttatcatgatgtggatgatgcgatccgtgcagagatcctgacggaggatgatattccgttagagatccggaaaacattaggttttaccacaaaacagcgtttaaatacattgatacataacgtgatcatgaatagtatgaaccaggatgacatccggatgtcagcagatattcaggaagccatgtttgaattgcgccattttatgtttgatcatgtatacacgaatccaattgccaagggtgaggaagtgaaggcaaaggcaatgatccggcagctctttggattctacaaagaccacattgagtttctgccggaaaaatacctcgccatgcttgatgaaggggaaaagacggagcgcgtgatctgcgattacattgcgggtatgaccgaccagtacgccatcaccaaattcagcgaatacttcctgccgcaggcctggcaggtggatggatactaagccaatatagcctgcggcgtgggaaggttgatgggtattatagacaattgcgaaactcataacgacctaaattgaattgtgagaaattgacaaaagacatgaaagacattggggagccgccggcacttagaaggcagatacaacggtaagttgtgtctggcttcttagtaccgttgcgagcgacacatagcgaaagcgtgtcttgaatgtttttgttaattttgaacaatttaaagaagactatgaggagtttcgcaattggctaatagatattaaaacgaaaggaggacacgcagtatgccgtatttttcggatgatataattgaagaagtgcgttccagaaatgatatcgtggatgtgatcggacagtatgtgcatctgacgaaaaagggaagcacctattttggactgtgtccttttcataatgagaaaacaggatcgttttctgtttctccgaataaacaaatgtactactgcttcggctgtggagccggagggaatgttttcacgtttatgatgcagtatgaaaactttaccttcggggaggcaatggaagccttggcggaccgggcgggtgttgccctgccaaagcaggaatattctgccgcacagaagagagaggcagataaaaaacagcggctgttggagatcaacaaagaggcagccagatatttttatacattattgcggaatgaccgtggaaaacatgcactcgcttatttccagaaaagagaattgtctgaggagaccatgaaaaagtttggtctgggatattcggatcagtacagtgatgacttataccggtatctccgttccaaagggtatgaggatgagatcttaaaagagtcggggcttgtgacaatcgatgagagacgcggcggctatgacaaattctggaaccgtgccatgtttccgattatggatgtccacaacaaagtcatcggtttcggtggcagggtgatgggcgatggagagccgaagtatttaaactcaccggaaacaccgatttttgataagagccggaatctgtatggacttaattttgcaaggaccacaaagaaaccacagtttttattgtgtgaaggatatatggatgtgatcgcgctgcatcaggcaggatttgacaatgcggtggcatcacttggaactgcgctgacggcaggacatgcgaatctgttaaaaaggtacaccaaagaagtgtatttaacctatgacagtgacggcgcaggggtgaaagctgcactccgggcgattccaattttaaaggaagtagggattacgacaaaggtaattaatatgcgtccgcacaaagatccggatgaatttatcaaggctttgggagcagaggcgtatcaggatcgtatcgatcatgcagagaacagctttatgtttgagatacgcattttagagcagcagtatgacatgaaagatccggagagcaagtcagccttttatcatgaagtggcaaagaaactctgctccttcacggaaaaaatcgagcgtgatatttacgttcaggcagtcgcggaaaaatatatgctgccaacgcaggatttacagcggcttgtcggtaaatacggaatgcagatggaaggcatccgaaaacaaccaacccagttaaaaaccggtatcaatgagaaaaacgcctccgccagaggaatcaaaaaagaagatgggatgaagcaatcccagaaacttcttttgacatggctcatagagaataccggattatatcataagataaaaaaatacatcgcaccgcaggattttacggaggagatatatcataaggtagctgaattattattccggcagtttgaggagagcggagaagcaaacccagcgaagatcgtcagcatgtttccagatgaggaggcacagaaagagattgcggcgcttttcaatgcaaggatccatgaggtcgagtcaaaagaagaccgggagaaggcattgaaagagaccattatccgcatcaaacaaaacagtatcaagtatcggtccgagcatttggcaccgacagatatggctggtctgatgcagcttgtaacagataaacgtgaccttgaagaattggagaaattgcatatttccattgattagggacaaaatagtagaaaacttgagaggatgaaacaaaatggcaaaaaagacagaaaaagaggtaaaggaaacaaaaaaagaagcagcagtgatggatgaagctgcaaaagaaaagtttcagcagaagttaaaagatctgttagccttggccaaaaagaaaaagaacatgttggaataccaggagatcagcgacttctttgcggacatgcagttagaggcagagcagtttgataaaattcttgattttctggaagcaaacaatatcgatgtacttcggatcacagatgatgattctgatgatgaaattttactcgatgtagatgatgaagacgagattgaagtggaaaaaatcgacctttccgtgccggatggcgtgtccattgaagatccggtccgtatgtatttgaaggagatcggtaaagtacctcttttaagtgcagaggaagagatcgagctggcaaaaaatatggaagccggtgctgtggcgaaggaaaagatcgcaatcttaaagagcagagaagagaatgcaacagaggaagaacttgcagagatcaaagaagagatcaagaatttgcagaaagatcttgatgcaggggatgaggcaaagaaacgtcttgcagaagcaaacttacgtctggttgtttccattgcaaaaagatatgtgggacgtggaatgctgttccttgatctgatccaggaaggtaaccttggtctgatcaaagccgtggaaaaattcgactaccgcaagggatataaattctctacttatgcaacatggtggatccgtcaggcgatcacaagagcaatcgcagatcaggcgagaaccatccgtatccctgtccatatggttgagacgatcaacaagctcatccgtgtttccagacagctgcttcaggagttaggacgtgagccaagtccggaagagatcgcagcagaaatgaacatgccggtagagcgtgtgcgtgagatcttaaagatttcccaggagccggtttccttagagacaccgatcggtgaggaggaggacagccatcttggagattttattcaggatgataacgtacctgttccggctgacgccgctgcattcacacttttaaaagagcagttggaggaagtacttggaacattgaccgagagagagcagaaagttctgacactccgttttggtctggaggacggccgtgcaagaacactggaagaagttggaaaagagttcaatgtaacacgtgagcgtatccgtcagatcgaggcaaaagcgctccgcaaacttcgtcatccaagcagaagccgcaaattaaaggattacttagagtaaaatggtaaagatttcaaatcgtttaatgacagccgcagctcttgtcacacagggatatacactggcagatgttggaacagatcacggatatattccaatctatctgttacagcagaagaaaattccagctgcaattgccatggatatcaatgaaggaccgttagagcgggcaaaagaacatattgctttatatggattgcaggcatacatacagacacgtctctcagacggtgtggcagctttgaaacccggcgaggtggaagctgtcctcatcgccggcatgggaggcggactggtcatgcatatcttaaaaaacggggaaaaagtctgccagtctgcgaaagaactcatcctgcagccacagtccgagatagagaatgtccgtgaatttttacgggaagaaggatatgccattctcgcagaggacatggtgttggaagatggaaaattctatccgatgatgaaagtgcagtatcagggtgaaaatgcacagaaagcttcggaagagttgaaactttcagacctttatggtggattactcctgcaaaaccgccatcctgtgttgaaaacttttcttgaaaaagaaaagctcatatacacaggcatcaaggagaatcttgaaaaacagccggcgtcagaaaaaatccggacacggcttgcagaagtggaagacatactgcattataatgaacttgcattacagttttatgaataatcccccttatttcaaaaacatccgcatcatcttttctttcaatccggtatatttctgataccggatcggcagatccatccacgttttcttatcgacaatactgcggtaatggctgaaggtttcaaaaccagccctgccgtggtagctgcccatgccgctctcaccgacaccgccgaatggcatatcgctcgttgcaagatgaatgatcgtgtcattgatacagccgccgccaaaacggcaggtatctaagaccttcttctgtgcagccttgtcctcactgaaaaaataaagcgcaagcggatgagggtgggattccacggtatcaagcgcctcgtctaatgtgtcgaaggtgaggatcggaagcagaggaccgaagatctcttcgcccatcacagcgtcgtcccacgtaatattattcagaacggtaggcgcaatgcggagcgattcaggctctgactgtcctccgtatacaagcttttccccattgatcagcccgagaatgcgttcaaaatgcttttcgttgatgatctttccataattcggatttttcagaggttctttcccaaactgcttttcaatctcagctaaaatcgcagtgataagctcatcgcggatgcgcttgtcacagagaatataatccggcgcaacacaggtctgtccgcagtttaaatacttgccgaagacaatacgctttgcggcaagccggatcttagcggtggagtcaacgatacatgggctctttccgccaagctctaatgtgacaggagttaaatattcagccgcatggcggagtacctcccgtccgacagtctttccgccggtgaaaaagatcatgtcaaaacgctgctgtaacaatgcctgattttctgcgcggccgccatcgaccactgcaacataatgtgccggaaaacattcttcgatcatggttttcatgacatcgaacgtgcaaggggcgtaggcgcttggttttacgaccgcagtattcccggctgctatggcatcgatcagcggatcgagtgtcagtaacactgggtaattccatggactcatgatcagcacggttccgtaaggggaaggggagcggaagctctttgccgcgaactgggcgaccggggtggaaacacgtttgctgcgcataaggctgcggagatgcttctgcatccaggtaagctcggacagcgtcagcccgatctcacacatatagctctccatacggctctttccaagatcctctttcaatgccgcagcgaggtcggcttcatggcggatcatagcctccttcaaactttctaactgtttcaggcggaattccgccggaatcgttttgccactggaaaaaaagtggttctgttgttgtaaaatatccttgatctcctgttcggtcatgaggatgcctccttttatcttccggatcgatcagacaattacctgttctgactcaacctgtatccgtacatctgatacttatatactatcgaaaataacatacttctgcaagtgttttacttccgggcagacaggaaaaacaattcttgaaaaacggcgctcataatgctacagtaataatactgatgatctgcagcagagatcatggcgcagatcagtttgataataatgtgtctgccggatacgaagggcagattgcggaaaggcatggaaaatgaaatgaacgattataaaataggcacaaaatgcgtacaggcaggatataccccggagaatggacagccgcggcagatcccgatcatccagtctaccactttcaaatacagcaccagtgaggacatgggaaaactgtttgatcttgaggcatccggatatttctatacacggctgcagaatccgacgaatgatcatgtcgcagccaagatcgcagcaatggaaggcggcacagccgcaatgctgacctcaagcggacaggcagcgaacttttttgccatattcaacatatgtgagagtggagaccatatcgtggcatcatcctcgatctacggcggaactttcaacctcattgcagttacgcttgccaaaatggggatcacggcaaccttcgtgtctcctgacgcatcggaggaggagttaaacgctgcgttccgtccgaacacaaagctgatgtttggcgagacgatagccaatccggcattgacagtattagatattgagctctttgcaaaaacagcacatgcgcacggcgtacctcttatcatagacaatacatttccaactccggtcaactgcaggccatttgagtggggtgcggatattgtgacacactccaccaccaaatacatggatggacatggtgcggcagtgggcggtgcgatcgttgacagcggaaaattcgactggatggcacacgcagacaaatatccgggactttgtacaccggatgagagctaccatggcgtgacctatgcagaaaaatttggcaatgagggcgcattcatcacaaaatgtacaacacagcttatgcgtgatctcggatgcatccagtcgccacagaatgcattcctgttaaaccttggactggagtcgctgcatgtgcgtatgcctaagcatgtggaaaacggacaggcagttgcagaatttctggaaaaacatccaaaggtagcctatgtaaactatccgggtctgccttccagcaaatactatgaacgtgccagaaaatacctgccacacggcggatgcggtgtcgtttcattcggattaaagggcggcagggaggctgcgtctgcttttatgcagaacttaaagcttggagcgatcgagacacatgtggcagatgcaagaacctgctgtctgaatccggcgacctccacacacagacagatgacagatgaacagctgaaagaggcaggtgttccggcagagctgatccgcatcagtctcggtttagaggataaggaagatctgatcgcagatatttcgaatgcgttggatgcgatcagggactaatatgcagaaaaaagaaagtgcagagagaaaaatgagtaagataaaaacaaaaaaagtgctgacaccggagcagaagaaaaagcgcatccgcaacatcatcattgtcgcagtgatccttgtggcagcatccgttgcaacttactggatgcagccgcagaacaaagcgctggcagagagtgaagtgttcagcgaagaggaagtgaaggcacaggcggaaaaaatcatagggcttttaaatgcagaggattttgacggcctgcaaagccttgttgtcccggacatgcaggagatcatgaacaaagagcgcatggacgaggggaaggcgcggatctcggaagactggggagattttgtttccattgaaacaatgcaggatgcggagatcatacagagaggtgcgcatatcgcagccgtttacgtgaccgcagaatatgaaaacatcgaggtgcattacacactggcgttcaacgaggacatgaagcttgcgtccttcgggatccaatagcggatcattcctgcggaaacatataggaaaaataaacatccttaaaattagcgtaattgtctcttgaaatcggaatctgtgcgccggattttgtgaagagagaggttttaccgaacttttccacgcagcttaacgctgcaatatagctgcggtggcatttataaaaccctttttccactgtgaaaattgtttcacactggtgaaagggttcttttatggagatcaccgagccgtctttcaatgtgactaacacattcttattctgcgcttccagatattcgacatcctgaaaataaatcgcctggtagccggaatctgttcttgccgcgaaatgagccatggaagccttgtggacttcgtaccagctgtcgaggaccgcatggaaacgcacttcgtcaagaggtttcaacagataccagaaagtgcggacttcataagattccagcgcaaattccggtgaggaagtcagaaaaatgatcggaacgtgcgggtcatgctggcgcagttcgcgggcggtatccatgccgcttaaaaggggcatgatcatatcaagcaggatcagatccatgccataagccctgtgtgcggagatcagttcgtcaccgtttgtgaaccggtagagctgcagtgtcagctgatgcgcccggcaccaggaatcaagactgtctgaaagcagatccaaaaattcagtttcatcatcacaaatcgcaatctttaccataataaatttcctcgcttaaagaataatgcggactacaaagtcctcaccttccatgtaaaactggtactgtccatgttccttctcaacataataaatgacgctttggacaccgataccgtgattctttgccgttgtaaccgggataccgtttgaaaaaacaggtgtctctgaagccggattcttctgcaggatcagaaggtggtttcccttttcaaaaatgctcagatgcacgatacgtttttcctcagggagcttcgtgaccgcatgcatggcattttccagaagattggaaaggatcgcacagaaagtcatctcagagcagcagagtgtctgcgaagtctggatctgtacgtcaaaaacgatctgattttccgcaaaccgtgtctggtaaatggaaaggaccgaattcagaagctcatttctgcagaaagagtgaatgaccgtgtcgtcatattgcttattgatctcctgaatataatcaagcgcgcgctccggttcctgctgggagataaaagtctggatggcagcaagatgatggcgcatgtcgtgccgcaggatcttcatgcggtgttcactgctgcgaacctgctcaatctccgagtgcagggagttcaactgcatattggtaagctgaccgtattgttcagcacggtttttcaactcatattcctgaaaatagacgaacaggaaaatgacataggaaatacacatggcaaatgcgagaaattccacgaccaccttatttccggagtaaagaagcatggagaactttgtggtagagtaatcaaacacataatagacaaatggcattgccccgaggatatacagctcccggtcagattttgccaaaagcagtgcggtagtctggcacagataccggcttaagaaagtgaaaacggcaacagtcacgataatccttaccagataataaacccattccaatccgctcagggataaggcaaaaatacctgcccagttgctgaactggcagcacagataggcggtcatgatagagattatggaaggcagccagcggaaacggtaataaaacaccagcagcagaaaaagcggcagatgcacgaaaagcggatagatggcttccgtgaacaacgaaccgaataccgtattgcagatcagaaagaaaagtccggatactgctccaccgccaagaagaatgcagacatttttcttattctgttttaccccgagaaaaaaggcggacagaaaaatgccaaacagcattgtcgttaagtggtgtgtataagttaaaatctgaagcagcatgtggcagtcctccttgtttcacagttatgatacatccattataaaaaattcggaaaaccaaagcaagcctgcatcttacaattcacgccatataattacaactcacgccgaaatccgggttttggatgaacgctgtgataaaatgaaaaaaatggtaaagtgacatattgtgaaaaaacaaacaaatgcaggaggagaatacacatgataagaaaaaagagaatgagcaaaggaattgcaaaaatactttccggtttactggtattcggaatggtagcaggtgttgttccggcagtaccgcacggtacattgcaggtgcaggcggcaaatgaacatagccatccggtctgtggtagtagctgtactgacgacagctcccacactaacttggaatttgcgaaactgacaggttcagaggacacactgaaaataggtgaaacaactatacaaagcactgataataatttagagttaccggcgggctgctattatttatcagatagctttgaaccaagctatagtatcattgtaaaaggtgatgttaaaatttgcctaaatggtcacaatattaatatgaagagtgcaggaaatgtttttgaagttgataaaggcggtacactgactctgacggattgtaaaggcagcagttctatttctcattcggatgtggaatggggaagaggcgtgttggtttctaacggcacttttaatatgtatggtagtaagatttgtaataataaatgtgcaagcaagtatcaagcaaacggcgcaggcgtggaggttgataaaggcacttttaatatgcatggtggcgagattagtggaaacgaagtttcaagcatgggtggagcagtttctagtctggacacttttaatatgtatggtggcagtattaccggcaatactgcacaatatttcggtggcggtgtatctgtgtataaggggacatttaatatgttcgatggtacgattagcggcaataaggtgacaagtgcaacgatgcagtcgcacggtggcggcggagtatgggtgcacacaaccggtacattttgcatgaagggaggaagcatcacaggcaacaccgcctatccctataattatgattataataaagctaatggtggcggtgtatattgcaggggcagtctggaactttccggctcaccggtaatcgaaggaaataagttgacaactggtgaaagtaacaatcttgttagttatatgaataagactaaaatcactgatacattaaacagtgacgcaaaaatttatgtttatatgaaagatacttctacgcaagatcagactttggcaactgttgatccaagcgtatcttcatttgatgcaaaaaacattttctactgcgataacgcaaattttgtagctgactttgacgcagcaaataatacaataaaatggacgacacacacccacgattggggagcatggacttccaacggcgacggaacgcatacccgtatctgcgcatcgaacagcagtcacaagcagacggaaaaatgttccggcggtacagctaccgataaagacagagccatttgcagcatttgtaacgcaccatacggcgaaatcaatgcgggctcaaatccagcgccgactccaaccccaaccccaacgccggctccaaatccgacaccggaagcaacaaccccgacaccggatccggcaccggctacatcaacaccggctacatcaaccacaacagcaccggcagcttcggcaccggcacaggtaacgtatgatattttggatggagcaggcagttcatggacacagaatacagatggaagccttgcaatcagaggaagcggtgagatttcaaaattccgtgaggtcaaggtggatggagtaacggttgatccaatcaattatacggtcacagaaggatctaccatcattaccttcaaaccggaataccttaagagtctgtcagcaggaaatcattcctttgaacttatttggacagatggaacagcggcaacaaactttacggtagccgaaaacactgaccagagtgcaaaatctccaaagacaggtgaagatttcagcatggcactttgtacagtacttctgatggtttcatgcgcaggacttgcaggaatttttgcgaaaagaaaaagaaaccatgccagataaggcattgcacaaataatttttcaaatgaaaaataagctgattacagagataaaagtgggcaggaaatttacaaaaaaaattctatttttatcaaaaatatgaatagtagaaagaggagattcaaatgaagaaaaagttattaacagcattacttgttggagcaatggctcttaatattacagcatgtggtggttcatcagatgcagcagcaccagctgacaatgatcagcagacaactacaacagacacagcagctgatgatgcagcagatacagaagaggatgcagtggatgtggaagatgcagcagaagcagcagacacaacagaggaagaaggattttcccttcttgatgtaacagcagatcttgttgatgcagcattatatgcagtggatgatgataatacagagtatgtgatcacactctttagagatccggatggatatagctatgtttcattaatgatcgttccacaggatggacagggagatgtcctttgtggagcatatgatgattctaatgtaacaaatgttacagatgaagataacattgactggactgagatcagcacaacagatgtttatacaggtgatgatttctcagcagtatttgtagaagcagatgacggttccgttgcaattgcaaattcagatttttcccttgttatggaaggtcagtatctgacagctgatgaagcaatcgattatatgggagcagcagctaactacatcaattagttttttgagatatgcggagtactggaagaacggttgcttcgcatatccttacataatgtaattcaaaaatcctgcacacttttatctctgtaatcagcacacatttatatagaagctgtaaaattcgcattgagttttacagctttttgcgtatagcaaaaaattaccttttattcatgttagatataagtatggatagctttgggattgtgaggtgaaaatcaaaatatatcaattacagattcaatgagaaatcattatcataccagaaatgtcgtatggagtaaaattccgcaagcaggcaaatacagacctttacaagctgtataacaccaacctgcatgagaagatcgagatgatgaaaaaggaaaaacatcagtaaaaagtcattgagaggattgctatgtcttgatataattaaaatgtattaattttgaaaaagatttataaagtcttgttaaaatggcaaaaatggaattgtgacaccactggtgtcacaattcggaaggtggaatatttgtatgggtaatgatttgatatcagcagctggattaattcatataattgaagaatcacgacaaagtgcattgaagaaagtgaatgaagagcttatcaaaatgtattggaaagttggtgagtttttaagtaaggaaacggaacgggcttcgtatggtgatgcatatatcgatgaaatttcaagggaaatacaggaggcgtttcccggaataaagggattcaatcgaagaggtctttatagaatgaaaaaattttatgaaacctataaggataatgagattgtgacaccactggtgacacaaattagttggacgaatcacttgttgataatgtcaggctgtaagactgatgaggaaagagaattttatatacgcctatgtatcaaagaaaactattcaaagcgtcagttggagagacagttagatagcggatattatgaaaggtatatgttatcaaaggaaactttattaccagagtcggttaagaagctaggagaaaatccatttttggattcatatgttatggaatttctggatttgccaaatgagtttcatgagaatgacttacgaaaagcgttaattagaaacatgaaggattttattctggaattaggaaaagatttcacatttattgatgaagagtacaaagttcaggttggaggagacgattttcgtattgatttgttgttttatcatcggggattacagtgccttgttgcaatagaactcaaaataggtaagtttaaaccagagtatatttctaagttggatttttatcttgaggcattggacagacaggtaaagaaagagaatgaaaacccgagtgttggcttgcttctttgtgcatctaagaatgatgaggtggtagaatatgctatgagcagaacgatgtcaccgatgctggtatctcagtatcagttacagttaccggataagactattcttgagaagaagctacagcagttggtcaatattccgcagattgaggattaaggcttatgggtaaggatatgatatttactctggaaagaagagtaaatggaaaaagagaattataatcagatagtatttacagccgttagggataacttagcggctatttttaatattaggaaatttctcccttcggagaaaacactaatataaaagcccgtattctgaatcactcatgttttttacaagctgtgcagtcattccttcaggtggatttttaatgtatttttctcttagttcctctattgctttttgtagaaaaaatttctcactatctcgtataaaagtgtgattgataagcattaaattttaataattttgtgattccggttgtgattttcatagatttcgcatataataaaagtgtgattataaagcataaaactccaataaaaatgtgaggagtgattcgatggaacgatttatcttaaaaaagttgctagattggaagaattctccctaccgcaagcctttaatcttgaagggcgtacgtcaggtgggtaagacttggattctgaaagagttcggcagacgctgttatgaaaatacagcctactttaacttcgacgaaaacgaagaatataaacaattttttgaaacaaccaaggatgtggaccggattctacaaaaccttatgctggcaagcggtcaaaagatcttgccagaaaagacactcatcatctttgacgaggtacaggactgcccgaaagtcattaactccatgaaatatttctgcgagaatgcaccgcagtaccatgttgcctgtgccggttctctgttaggtatcgccttggcgaagccttcctcttttccagtaggcaaggtcaacttcatgcagattgacccaatgaccttcgctgagtttctacttgccaacggtgatgaaaatctggcgcagtatctggaacaggtggatacccttgaacctattcctgacgccttttttaatccgctgtatgagaagctgaagatgtactatgtcaccggtggtatgccggagtcggtattgatgtggacggaggcacgggatgtttctgccatgcaggaggcattgtccggaatccttggagcctatgagcgtgattttgccaagcatcctaatctcagcgagttcccgaaaatctcaatgatttggaagtctgttccttctcaactggctagggagaacaagaagtttatctataaggtggtcaaggaaggcgcacgggcccgtgagtacgaggatgctttgcaatggctggtggatgcccgtctggtgcataaaatttatcgcagctcagctcccggcttgccgattgcagcttacgatgacttgtctgctttcaagatttatttggtagatgtgggactgctccgccgtctggcacagttggctcccactgcctttggcgaaggaaaccgcctgtttactgaattcaaaggcgcattaaccgaaaactttgtgttgcagactttaattactcagtttgaagtcatgccccgttattggagccagaacaacccaccttacgaggtggatttcctcattcagcgggagaacgacatcttccctgtggaggtcaaatccgaagccaacacaaccagcaagagtatgaagaagttcaaggaactgttccctgataaggtcaagcttcgcatccggttctcattggacaatctgaaactggacgatgatgtgctgaatatcccactgttcatggcagatcaggcggatcgattgattgggctggcattggaaaagaggaagcaatagaaactgaaattggcacatttatggaattgctttttgcggcaaaaaggttgagatagcaatgtgaagccttctgatccattctgcacataaaataaaaacgaaaaacctgtttataaatttaaaggtgaatatgaaacttcttcgcattacagcagaaggattgctgttattcaaggaaaaattggatttttctctttacgtatgaggtgaaaatggcaactaagtttacaatatgacacattaaataattgcgaaactcacgaaaacctaaattgaattgtgaaaaattaacaaaagattgagaaaacactggggagccgccggtacttagaaggcaggtgcgatgttaatcgtgcctgccttcttagtaccgctgcgagcgacacgtagcgagagcgtgttttcgaaatttttgttgattttgaacaatttaaagaagcctacaaggagtttcgcaattgcctaaatgtaacgctaactctgtttcttaaaaaacgcttttgtttccctgacaacaaccccactcaatacgaacagtgcgatcatatttggcagagccatcagtccgttgaaaatatcagcgatcgtccacacagcgctgacggtcatatacggtccgataaatactgcaaaaatgtaaatccagcggtagactttcacatgttttaaattgccgccgcttaaatattcaagacagcgttcgctgtaataatcccagccgagaattgttgtaaatgcaaaaaatacaaggcagagcattaatacaaaagaggacacggccggagggaaaggaagtccctgctggaatgcgtaagtggtgacttccacaccttctaagccttcgacctgccatgcgccggttaagacgatggagagtccggtcagtgtacagattacgatcgtgtcgataaaagttccggtcatgctgacaagtccctgacggacaggttcttttgtctgtgcagcagcagctgcgatcggggcgcttccgagtcctgcctcatttgagaaaataccgcgggcaacacctttttgcattgcgacaaacatacttccgacagcaccgccggtaacagctttcggtgtgaaagcagcggttacgatcactttaatagctgcaggaatttcagtaatattgcagatgatcaggataacggcaaaagcaaaataaaggatcgccataaatggtacaacgatctggctcacacttgcgatccgttttacaccgccgatcaatacggctgcgacacagaccgtcagtatcagggatgcgatcacgactgaccaggaatattctccgaggaaaggaaggatcttgacacagtgtgcattgtccggatcaaagaaaccgttgatcgcacttgcgataccattgacctggctgaaagttccgataccgaaaagtccgacacagacgccgaaaaatgcaaaaagctttgcaagccatttccagttttttcccattccctgttcaatataatagaaaggaccgccaaggctgtggccgtcaggagcaacgacacggtatttgacagctaaaagtccttcggaatatttggtagccattccgagaaaagcggctgcgaccatccagaacagagcgcccggaccgccggcgcagacagcggttgcaacacctacgatattaccggtaccgatcgttgcgctcaaagcagtacagagagctgcaaaactggaaatttcgccttctgcctcttcctcattctggatcatccatttcagcgcaaggggaagcttccggatctgtaacagaccgaggcgcaccgtaagcagcaggccgcccgccatgatcagcaccattaatggcacaccccagacaaaattgtcaacattgacaagaaaatcattaattacactccacatgtttctaatcctctatctttctttcaatatatacatcgagtgcatgcagtatcacagaaaaatatcttgcaatgaaaatgggatgatgaccggaaacaggatgaactgacagaaaaatatcccatataaaatatatgggataggaagatacataatcagaaaacttcatataaaatgaaatcttatgtgtgcaattaagatatcttctctgtccgcttgcctgagagattcatacgaaaacgtatgttgcaccttcggcccccggttcatccgggtgtctccagagagtcgatccatttacagttgcaccggtatgaccggcacctgagagtgttactccttcggtagacttgcgtcgttttcctgcaaacttcatctcgaaattgttgattcaactatatcgtgtaagaatacaaattgcaaggaggtttttcctgttttcctgcatttatgcaaaaaaatagggagaaaaaactgattcataagaaacgcttataaaagaaaacaagtatacgaaaatataggcagaagaataaaactgtcaaattctgaaaaaaatataaaaagtgtgaaaatgccttgatgtttcggaaattttgagagaaactaaaagaagaatgacaacagagtaacaggcagagatccgtgcatcttcggaacgtgatcgcggagatatggattgatgatgaaaaagtgtaagagaagggggatttttttatgctgcaggaatggaaagcaatggaaaaaccggaggaggaagagatcagggtgcgccttgccgctgcaaaagaaaagttagcaaagcagcagcttttgatcaaagagcagaagataccggtacttgtgctcatggaaggctggggaaccgccggaaaaggttccgtgatcggtcaggtgatccagaatatcgatccgcgtttcttcaaggtggaatcaatgggagaaaagagtgaggaagagcgtcgaaaaccatttttataccgctatttcaaacgaattccggaagaaggaaaattcgtatttctcgattcgggctggatggatgagatcgtaaaagacgagctgcacggaaaactttccgatgaggattacgcaaaaagaatcgagagtgtgagacgttttgagcgccagcttaccgataatggttatctggtcatgaaatttttcctgcatatctcggagaaagaacaggcaaaacggatcgaacacttggagcatgaaaaagatacggtctggcgtgtcagcaaaaatgatctctggcagaaccggcattatgagaagtgcgaagaggcattttcttcctatatgaaaaacacaaatatgccgtctgcgccgtggtacattattgatgcaaagtcaagaaaatggacggaacttcaggttttagagacattgacacagggaatcgagattgcgttgagtaatcagaaactggcagtgcctcttttgcagaatgttttcccgttagtcccaatgccgcttttgtcagaagtgccgttagacaaagagattgagacggacgagtaccgcaaagaactgaaagaattgcagaatcggcttggagaactgcacaaccgtctttaccggaaaaaagtaccggtcatcatcgcttatgagggttgggatgcagcgggaaaaggcggcaacatcaagcggattgcaggagcacttgatccgcgcggttacgaagttcatccgatcgcaagcccggaacctcatgagaaagcaagacattacctgtggcgtttctggacgagactgccgaaaacaggacatatcgctatttttgaccgcacctggtacggaagagtgatggtggagcgtctggagggattttgcagtgaaaatgactggatgcgcgcctacaatgagatcaacgaatttgaaaaagaacttcacgactggggtgctgtgatcatcaaattctgggtgcagattgacaaagatacgcagcttgagcgttttaatgagagacagaatacaccggaaaaacagtggaagatcacggacgaggactggcgcaaccgtgataaatgggatgcgtatgagacagcggtcaatgagatgatcgcaaagaccagtaccacctacgctccgtggcatattttagagtctgtcgacaagaaatatgcccggatcaaagctcttaagattgttgtggaggagctggagaaggtgttggggtaaaggataatattaagccagttcagcttccagcttattaatatgtttgaattcaacgatcaccatgctaaggccgactgcaaaggacagaaggtcggcgatcggtcctgcataaagcacgcccataatgccgaaaaaatgcggcagtgcaacgataagcggcagcaggaacagaatctgtctggtcagggagaggaaagttcccttgtacgcttttccgatggaactgaaaaacgtcgaggagatcggctgcaaaaagtttaaccaggtgaagaacaggaaggctcggaaatagttgacaccgaactcaaaatattcttcgcttccgcttccgaacagaccaaggatctgtctcgggaaaagctggaacagcaaaaaggaaataatggatacaaccgcaccgactgacgctgcgagaaggaaagcgtccttcacccgtttgtattgctttgcaccgtaattaaaactttcaattggctggcttccctgggacagtccgataataatagaaaaataaagctggtttaccttcatgacaattccggcacaggcgatcgggatggattcgccataaacggactgtgcgccgtagtgttttaacaggttgttcatgacgatctgcacgatcatcatggcaatctggttaatgcctgaggacatgccgagggaacagatctgtgcgagaactttcccggaagggataaaatgctgtttttctaatgtcacagtgcggtaatgcatgaggtaacggatcgcaatcgcagcggagatgatctgcccgatgacagtcgcccacgcagcaccatacattccccattggaaaccgaatacgaacagtgcgtctaagacaatattaatgacagcacctgaaaccgtgacaaacattgccattttcgggctgccgtccgcacggatcaggtgaccgcttccgatggttaaaatcagaaatggaaaaccgaccgctgtgacgcggacatattgctctgccagtgggagtacatctgccggggaaccaaagagcactaacagtggatttaaaaacagttcggtgataagcagtaaaagaaatccgagtgagagcagcatagtgatggagttgccgatataataaggagcttcctcttttcgtccagcacccatatgaaggttaaagcttgctgctccgccgatcccaaaaagcagtgccagcgaagtgcagagcatagagagaggaaaggcgatattggttgcagcatttccgagcgtgccgactgcatttccgataaaaagctggtcagcgatattgtaaacggcgctgacaagcattgcgataatgcttggaacagcaaaacgtgccaccagcgtggaaattctatcggtaccaagtggatttgtcatttgttttttctgtgtcatgttgataaactccttttttataaaattcaggtgtcaaaatgtctgtattttcatttataatatcaaattgtacatcaaaaattgtgaatcatttgaaaccagaaaaattgtaagtctgctaacattttctgtcaagaataaaaaattataaaatgtctctgaaatttttatgaaagaatcacggaaaggctttaccaaaccgaagaacgcagataaaatggaactcataaagcaagcgaaaaacaggagaagcagatattgaatacaaccaaaatcgcactggaagcgtcattgaaagaacttttaaaaaagaaaccttttgataagatcaccatcgcagatctgacagaggactgtgggatcagccgcatggcattttactatcatttcaaggatatctatgatctggtggagtgggcatgtgtggaagacggcaaaaaagccctgcgggataagaaaacttacgatacctggcaggaggggtttgcccagatttttgaggcagtactggaaaacaagccgtttattatgaacgtctatcattcggtaagacgtgaaaagatcgagagctttttatacaaactgacataccagctgattgcggatgttgtagaggaaaaatgctccagagatcatctgccggaaacagataaacagtttattgctgatttttacaaatacggttttgtcggcatcatgttagactggatcgaccgtggaatgaaagaggattatcagaaaatcgtagatctgctcgcagtgacgttgcatggcaatattgccaattccatccgtaattttgaacaggagaaggaaaaaatgtaatttgcgataaagaagatttgagcaattgaaagaatattatggggcgtttcgcagacacccataggattttttacaaaaaaggtgaagtgataaaatttttatcatttcaccttttttgtaaattggcaatcattttggggcaagctatcatagagacatcaaaaaatagattagacaattgcgaaactcctagaaacctaaattgaattgtgaaaaattaacaaaagcttgagaaaacactggggagcggtcggtacttgaaggcaggtacaacaatcgttgtgactggcttcttagtaccgttaccagcgacacgtagcgaaagcgtgttttcgaaaattttgttaattttgaacaattgaaagaagattatgaagagtttcgcaaacgcctaaaaaagaggatcgatgaaaggagtaatgaaccatggaaaagaaaaacattggacttggagtagctgcacttgcagcaggagcaggagtcgtggcacttgccgcaaagaatcataaggataacgtcaaaaatgaggtgaaaaaagcggcagcaaatgcacctgagcaggaataccgtaatacagagcgcggaaaaaatgaaaaaaacagcaaaggcatttattataccaacggtaactatgaagcttttgcaagacctaagaaaccgcagggggttgacgaaaaaagtgcatatatagtaggaagtggccttgcttctctggcagcagcctgctttctggtaagagatggacagatgccgggagatcacatccatattttagaggcaatggacattgcaggtggagcatgtgatggcatttatgatgcgaccagaggttatgtaatgcgtggcggacgtgagatggaaaatcattttgagtgtctgtgggatttattccggagcattccatccattgagacgccgggagtctccgttctggatgagtattactggttaaataaagaagatccaaactattctctttgccgtgcaacggaaaaacagggaaaagatgcgcacaccgatgggaaatttaacttaagtcagaaaggctgcatggagatcatgaaacttttcatgacaaaagacgaggatctttacgataagacgatcgaggatgtatttgatgatgaggtgtttgattccacattctggctgtattggagaaccatgtttgcatttgaaaactggcacagcgcattggaaatgaaactttatttccagcgttttattcatcatatcgcaggactgccggatttctcagcactgaaattcacaaaatataatcagtatgaatcactgatccttccgatgcagaaatatctggaggaagcaggtgttgatttccagtttaatacagaagtgaccaacgttatttttgagatcaaagatggaaagaaagtggcaaaaacaatcgagtgcaaggtaaaaggtgtggaagagggcatcacattaacggaaaacgatctcgtatttgtcacaaacggaagctgtaccgagggaactatttacggagaccagaatcatgcgccaaacggtgatgcagaggttcgtacaagcggctgttggaatttatggaaaaatattgcaaaacaggatccgtccttcggacacccggagaaattctgctctgatattgcaaaaacaaactgggaatctgcaaccgtcacaacattagatgataagatcattccttatattatggatatctgtaagagagatccgagaagcggaaaagtcgtgacaggtggtatcgtgagctgccaggattccagctggctgttaagctggacgatcaaccgtcagggacagttcaaagagcaggataaaaatcaggtctgcgtatgggtttatggattatttaccgatgtaccgggcgattatattaagaaaccaatgaaagaatgtaccggaaaagagatcacagaagagtggctttatcatctgggcgttccgacagaaaaaatcggagagcttgctgaacacagcgccatctgtgttccaaccatgatgccatatatcacagcattctttatgccaagaaccaaaggcgacagaccggatgttatcccggacggctgcgtgaacttcgcattcctgggacagtttgcagagactccgagagataccgtattcacaacagagtattctgtgagaactgcaatggaagctgtttatggattgcttggtgtagaccgtggtgtgcctgaggtctggggaagtgtttatgatatccgcgaactcttagacagcagtgtaaaactcatggacggaaagtctccgcttgaaatctcattgccgggaccgttaaacgcattgaagaaaccattgcttcgtgtggtaaaaggaactgtcattgaaaaagtactgcgcgatcataatgtgattaaagaaggtatgatctgatttttcaatctgaaaaacagacaaaaaagaaatgtaattttttgtcaaaaaagatgttgacaaatgaaatgtggtttgttattattaacaggctgtcgcaagtaagtgataacaaaccacttcaaaacgaagcaaaacaaaataaaaaagttgttgacaggcgcagatgattatgataatatatcagagttgctgaaaacaacaaagaacattgataactgaacagtgaataaccttgaaagattcataagagaataattcaagtcatcgaaagatgaacgaacagcttttaataaagcaaaccttaaaaacagtaaaacctgaatcaagattccggtaggaacttgtttctgatttagaaagccagatattctggtttggatttaactttttaacatgagagtttgatcctggctcaggatgaacgctggcggcgtgcttaacacatgcaagtcgaacgaagcactttgatcgatttcttcggaatgaagttttagtgactgagtggcggacgggtgagtaacgcgtgggtaacctgcctcacacagggggataacagttggaaacggctgctaataccgcataagcgcacagtaccgcatggtacagtgtgaaaaactccggtggtgtgagatggacccgcgtctgattagctagttggcagggcaacggcctaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaaatgacggtacctgactaagaagcaccggctaaatacgtgccagcagccgcggtaatacgtatggtgcaagcgttatccggatttactgggtgtaaagggagcgcaggcggaaggctaagtctgatgtgaaagcccggggctcaaccccggtactgcattggaaactggtcatctagagtgtcggaggggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcggaaagcacagcttttcggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatccttctgaccggacagtaatgtgtcttttccttcgggacagaagtgacaggtggtgcatggttgtcgtcagctcgtgtcgtgagatgttgggttaagtcccgcaacgagcgcaacccttatccccagtagccagcatttcgggtgggcactctgaggagactgccagggataacctggaggaaggtggggatgacgtcaaatcatcatgccccttatgacttgggctacacacgtgctacaatggcgtaaacaaagggaagcaagaccgtgaggtggagcaaatcccaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttggaaatgcccgaagtcagtgacccaaccgcaaggagggagctgccgaaggcaggttcgataactggggtgaagtcgtaacaaggtagccgtatcggaaggtgcggctggatcacctcctttctaaggaaatcgagtaaaagttattcactgttgagttatcaaaaagataacagaaaacttctggtggcgatgcgcttttgggaaacacccgtccacatcccgaacacgatggttaagacgaaagcggccgatgatactatactggtgacggtatgggaaagcaggtggctgccagattgaaatgggcttatagctcagccggttagagcgcacgcctgataagcgtgaggtcggtggttcgagtccacttaagcccattggcgagagcctttgaattgaataaaaatccaaatgggggtgtagctcagttgggagagcacctgccttgcaagcagggggtcaagagttcgaatctctccatctccattcggtcagaaacataaaactgtgtaactgaccagaaccaaaagcatttgaaataaatgtagattggtacagaagtttcgaagaaacttctaatggcttcgctttgcgaagactatgtacattgaaaacttcatacagagataagtattgagaaaaatatctgtgaaaacatatatttgatcaagacatccgagaaaacaaataaccaaacgtaaacatagttgaaaaactaattacaagctttttaaaaagcagaccccatttcaaacgctattgaaatggtaaaagagaggtcaagcaaaaaagagcgcagggtggatgccttggcactaagagccgaagaaagacgtgataagctgcgaaaagctgcggggaggagcaaatatccactgatccgcagatgtctgaatggggaaacccgcatgagcaaccctcatgcatccatacgccaatccataacgtatggaggggaaccgcctgaactgaaacatctaagtagggcgaggaagagaaagaaaatttatcgatttccaaagtagcggcgagcgaaatggaaagaggccaaaccggagtgcgtgcactccggggttcggaccgcatttaagatctgatgatcctagcagaaaggttttgggaaagcctgccagagagggtgaaagccccgtaagcgaaaggaaagccagctgagcggtatccagagtacatcgagacacgagaaaccttgatggaatgagcggggaccaccccgtaagcctaaatactccttagtgaccgatagcgcatagtactgtgaaggaaaggtgaaaaggaccccgggaggggagtgaaagagaacctgaaaccctgtgtttacaagctgtgggacatctttacatgatgaaccgcgtactttttgtagaacggtccggcgagttgcggatgccggcaaggttaagcacttaaggtgtggagccgaagggaaaccaagtctgaagagggcgcatatagtcagtatccgcagacccgaaaccgggtgatctacccatgtccaggttgaagttgccgtaaaaggcaatggaggaccgaacgcacatccgttgaaaagggtggcgatgaggtgtgggtaggggagaaattccaatcgaacccggagatagctggttctcctcgaaatagctttagggctagcctcgttttagtcttatggaggtagagcactgaatttccgcgggggcgtcaaagcttaccaaagaatatcaaactccgaatgccatgtagatgatgaacgggagtcagactgcacgagataagttgggcagtcaaaagggaaagagcccagaccgccagccaaggtcccaaagtgtgtgttaagtggaaaaggatgtgggatctccaagacaactaggatgttggctcagaagcagccatacattcaaagagtgcgtaacagctcactagtcgagaggtcctgcgccgaaaatgtccggggctgaaacacaacaccgaagctgcggaattgcgaatgcaattggtagaggagcattcttaataccgacgaagctgtaccggaaggagcagtggagggataagaagagagaatgccggaatgagtagcgagagagaggtgggaatcctctcggccgaatatccaagggttccagagtaaagctgatctgctctgggtaagtcggggcctaaggcgaggtcaaaagacgtagccgatggacaacaggtttagattcctgtaccgcatataaacagaactgtggggacgcatggggagagcatgggccgggaatggaaataccggtgcaagcgaaggaggtgtgcagccggcaaatccgctgcatgagccgaaagcgtgacgcggagcgaaatgaaagtagcgaagcatgtgagccctgtgccgagaaaagccgctattgctttatatgtgcccgtaccgtaaaccgacacaggtggatgaggagagaatcctaaggccggcggaagaagtattgttaaggaactcggcaaaatgaccccgtaacttcgggagaaggggtgcccatgaaagtgggccgcagagaataggctcaagcaactgtttagcaaaaacacaggtctatgcgaaaccgaaaggtgaagtatatgggctgacgcctgcccggtgctggaaggttaagaggagaggtcagcgcaagcgaagctttgaatttaagccccagtaaacggcggccgtaactataacggtcctaaggtagcgaaattccttgtcgggtaagttccgacccgcacgaaaggcgtaatgatttgagcactgtctcgacaatacatccggtgaaattgaagtaccagtgaagatgctggttacccgcgccaggacggaaagaccccatggagctttactccagtttggtactgggattcggtactgcacgtacaggataggtgggagactttgaaacttgaacgccagtttgagtggagtcgctgttgggataccacccctgcagtattgggtttctaaccagtcaccgtgacccggtgatgggacaatgccaggcggggagtttgactggggcggtcgcctccgaaagggtatcggaggcgctcaaaggttccctcagaatggtcggaaaccatttgaagagtgcaaaggcagaagggagcttgactgcgacaccgacgggtggagcaggtaggaaactaggacttagtgatccggtggcataaagtgggattgccatcgctcaacggataaaagctaccctggggataacaggcttatcactcccaagagttcacatcgacggagtggtttggcacctcgatgtcggctcatcgcatcctggggctgtagcaggtcccaagggttgggctgttcgcccattaaagcggtacgcgagctgggttcagaacgtcgtgagacagttcggtccctatccggcgcgggcggaggatatttgagaggagctgtccttagtacgagaggaccgggatggacggaccactggtgtatctgctgtcggccaacggcatggcagagtagccaagtccggaagggataaacgctgaaggcatctaagcgtgaagcccccctcaagatgagatatccctcacaaaagtgagtaagatcccttgaagactacaaggtagatagggcagaggtggaagtgtggcaacacatggagctgactgttactaatcgatcgagggcttgaccacagaaactcggaatctgtatgaagttttgaatgtacaaaagacattctaaaagaagtaaaagaaatattcctcgatagctcaatggtagagcgcacggctgttaaccgtgatgttgtaggttcgagccctactcggggagtttttttaaatataaggctccgtggtcaagcggttaagacatcgccctttcacggcggtaacacgggttcgattcccgtcggagtcactagaaaagtatgccgatgtggctcaattctcgacaattgaggaggaacgagtcaattgtaggcagagcagctggttacaaatcagctggaaagtcacatgccgatgtggctcaattggcagagcagctgatttgtaatcagcaggttatcggttcgagtccgatcatcggcttttttgaaggaacaagagtccttgaacaaggaccattagctcagttggtcagagcaaccggctcataaccggtcggtcctgggttcgagtccccgatggtccactcaaaagaaaagaataaggcctaatggctcagttggttagagcgccgccctgtcacggcggaggtcgcgggttcgagtcccgcttgggtcgttctggaagtttagctcagctgggagagcatctgccttacaagcagagggtcacaggttcgagccctgtaacttccacttgcatcagtttctggtgcagaaatgccggcgtggcggaactggcagacgcgcaggacttaaaatcctgttgtagcgatacagtaccggttcgattccggtcgccggcattcatcgaaagggcacttgacaagagtgttataatagatgtgaagaagttaatagaatatgtgtgcgtagctcagctggatagagcacttggctacggaccaaggtgtcgggagttcgaatcttctcgcgcacgtatcggggaacggtcttaaatccttataaattgggggtttaggactgtttttatgtttgagaggacttgtgaataatgtttacccaacctttgttttcatcggaatcacattatccggtgcagcctgattgagcagattgaagaactggctgtcttcaaggtcatcattggttgagcggatatattccaatgtctgttctaatgtctcatgtcccatgactttttgaatacgtttaggtggcatgccgtttaaatacagatttgtgcataccgtccgacgtacatcatgtggactcttgattactggcattccggcttttttacaatatctgcgaagatatgaatcaaaacatctctgagtacatccacagacgatcccattataacttctcataaagataaagtctgactgtgtaatcggatagcctttctgggtattgagatcttttacacgcgcaagaatctgaatggctcgttcgcttagtgtaatctcacgatatgcggctcgagttttaccgtaatttacgatacggtacccctttgcttttccgcttgtgcagtcagtcactaactgacgttcaataacaagcttcgaattgcctttaatatccttaatgatatttccccaggttaaggcgcataactcgccatctctaagcggaagctcaaaaagcagcgcaatcgcataatatttcgcttcaccggtagcctctgcttcattcatggagaacttacatacagaggttctctccacagtgctgaaaacggtatcttcttcacatgttttatccgggatacagaatacatcttttccaagtttcatgttagcaatcggattataagtcaataaacgtttgtcgatagcatactgcataatgccatttaatacgcttcttacatttgtgaagtattttctggtcatgtgcggataaatggataaacaataggatacctactcatagccgtcgtcaatggttatatcttgaatgtttttcgtaaataaaggagaattctttagaaaacgttcataccaacctctatgctttaccagagtacgatcagtacttcttttttcatcgattgaaaaccatgcttctgcgatatcatctaatgtttttgctgttgctgtctcggaatattgagatacaatccagtcttcgagttctttccggcttttaagagttttctgtttgccatttactcgtgttgtccacctgccacgtccctcgaggaaagtgataggtgttgtgtgttttttgagaatctcttctcgtttcatttctgcctccttctctgaaagaagggcctgcagtctttcgaattccatctttgcatcagaaatggattctgtcaatgttttttcgtgattttccataatgtcacctcatgatatttagcgatcttggatgcctaagttgtactaagttacagtattgagaaggcttaatttgtaaaaaacacggcagaaactttgcgaaaacaatgataattaagaaaatattaataaaacaacaataaaaacttaaaaaaattgacgagatgtttaatcattgtaaaccatagattatgagtgctataataaaaatatcattgtggtatagtgatgagcaaaggcgagtttaattcggtgactcaggtaaaaggccgtgaaaacatggcagatacggtttatttttctaaaattgaatactgcgaggttatcggatacgggcacacaacaagtaaggttcttggtgtacaagcataaaatttgcaaattgaaaagattacgaagtgagagcgggtatgtgtcctgctcttattttttttgacagagacagaatggggagagaggacatttagaaagaactactatgtaaacaactactagtgaaagaactactatgtgaacaactactacgtgaacaattactatgtaatcaactactatgcatattaggacctattgatagaagcgttttactactcaaatgtatgcccttttgtatttatgtctgcaaaatctaccattctaacagatttattgggaaatcgacatgttgagattacaaactactacttgttaaactactacgttattactttatatagtaagtaatgtattcaatacccggggaaaggcatacagggttccttatgtcgcgcgcattgatcgtattcacaggagagcgtgcctcgatgctgtattctggcacagtttggcgcctgataaattagaacccaacattttgttcccatatcccttaaaacccagtatgttcccacagatctgcgcccattatgtagttttcggtaatgcggatcctatagcatttgcatatgcgtactctgaatccgggtgttttgataccggtccatttgcatacggttcaatcgatatcgtttcgctcagtacacttctatccgcatccgttttctggacattcattcccgacagtacccatttgtctgatattaaaatattggtatgcgcacatcccggtatcagcttgtaggtatgcgtaaatgtttcagtatcgcttattagtatgcaatatgcctcggtatcgctcatccgatatcagcttattggtatgcggaatgtctcgatatcgctcatccgatatcgccttataggtatgcaatatatcccggtgtcgcttactagatatcgccttattggtatgcggaatacctcggtatcaatcatcagataccaccttacaggtatgcagtatattccgatatcgttcaccatataccgccttagtgatatgcagtatgtttaatcgttgtaaaccatagattatgagtgctataataaaaatatcattgtggtatagagaaggaatgctgaaatgtatatacagatatttgggacaaagaaatgtaatgaaacgaagaaggcagagcgattctttaaagaacgtggcataaagtatcaatttattgatatgaaagaaaaaggtatgagcaaaggcgagtttaattcggtggctcaggtaaacggcggattagagaatatggttaactgggacggaaaaaataaggacttgcttgcgattattaagtatattgcagatgaagataaattggagaaagtacttgagaatcctgaaataattaagacaccggtagtcagaaatggtaaacaggcaacacttggatataaaccggatatatggaaaagctggaattagaatgtgtataaaaggaagtgaaaacatggcagatacggtttatttttctaaaatcgaatactgcgaggttatcggatacgggaacacaacaagtattatgctgttgaatattccagagcaggaattgtcgtatcaggtatatgactggaaaagacaaatgccggcaatagaaggtatgcagacaaaagagataaacaaatatacatggacatatgatattgcgcttccggcaaagaaaatccgaaatgggaaaacaggatttgaaccgcaattcatccgggatgaagaatataacccagaaattactttttcttatgcgattaagctgaccgatgatcaaatgcaaatgctgttagagattccgagagactattatagaaaaagagaaaatggtatagaattcagctgaaagaataaggtactgcccacagtggtaagaccttattctttttttatatcataatttaccaaaacgttgttgatttttaaaaatgggggtgttagtatataaataccaaaacgttttggtaacaaatactgtgtaatattaaaaaaagtacacagtatgataccaaaaaaattaagcgaaagagaagacatggagggaaatatgacggtaaaaggacttatttttgatctggacggggtaattgtatttacagatcagtatcactataaagcctggaaacaaatggctgacgagaaaggtatttattttgatcaggagattaataacagactgcgaggggtaagccgtatggaaagtctggaaatcattctcgaaaggtatgagggagagccgctgagcgatgaagataaacagaagatggcggaggagaaaaacgagatttataaaaaacttttagaacagatgacaccggcagatgtcagtgacgaggtgaaggaaacattggatgaactgcgtaaaagagggtatctgctttcaattggttcatccagtaaaaatgcgaaatacattcttgaaaggaccgggatcatggataaatttgatgcggtttccgatggaacaaatatcacaagatccaaaccggatccggaagttttcttaaaagccgcagagtttttaggtttaaaaccggaagaatgcggtgttgtggaagatgcgtatgcgggaatcgatgcggcagtttcaggacacatgacatctatagcaatcggcgacgcagcgggttatgacaaagcagattataaactgtcagcattcagggatctgttggacatcgcaaaataggaacgtgacacatgcattcctcatttttgcagatggaatataatggaaaaatgtgataagataggtattaatttgtggaaatctgataaatcgggggagtttgtatggataagcaggaaaaagaagttctgaataagaggacgacaattcatgacgttgcacatgaggctggggtatcgatgactacggtatcccacgcactgaatggatataaagatgtgaatgaacagacaaggcagaagatcgtagaaattgcgaggcgtctggattatatgccggatgaggcaggacgctcactgagagggatacagaagaagacgatcgcactgctgatcgcaggagaactgctggaggaagatccaagcggcatcatgtatggacttacaagcggaatttacaaggtggcacaaaaaatggagtatgaatttacaatcctgacaatgccgtccgataaacagttgaaaataagctttggacagatctgcaagaggaagaaattaacggggattatcgtttacggtcttgccatggacatgccgtattatgagcagatcaaaaacagtgagatcccatgcgtccttgtggatgtagccatggatggcgataacgtaagagaagtttccgcagataatgagaaagcatccttcgaggaggtcgagcatctgatcgagaatggatactgcaacatagcaatgctttccggtaagaaaatggcacaggtgtcagaacgaagggaaagcggatacaagcgtgcattagagaagcatggtttccgcgtcagggaagaatggatcgtggactgccagtttgaccaaagtacggcaatgcagaaagcaatggagttaaagcgccgctatccggggattgatgcatttttctgcgcaagcgacggcattgcaatcggagcgatcgatggcatgatgcagcttggaatgcaggtgccgcaagatgtggctgtcgctggttttgatgattttactgtttcaaaatatatccatgggggaatcacatctgtcaaacagtatccatatgaaatgggagtagcctgtgccaacacagttgtcagcatgattgatggaaaccgcgtaccggactggatacctatggaatacaagctgatgaaacgcacatcaacgaaagcaaaattgtaagaagtatacaaattatacaataaaaattgttaaatatgacgaaaaaataaaaaaatacacaaaaagcttgaaatccaaaaggttttggtatattgttaactcaacagttaccaaaacgttttggatttttgctttttacacgtttatcactaggaggaaaaagatgaaaaaaagagttttatcaattttacttgtagcagcaatgacagcttcccttgcagcgtgtggtggttcagacagcagcaataacagtgcgtcgggaagtggtgagatcacacttacaatcccgaccttctgcgtaggagaaaatgttggcgctgtatattttgaacctgccgttgagagatttaatgaggcaaacaaaggaaaatatcatattgaattagaggaagtcgttgaggcatcttatacagacaagatcagccagctggcacagtctgattcacttccgacactgatccagacacctgacatagaatggatcaagacagcaatgatcccgggaaaactgtattacccgatgaacgattttctggatgaacatccggagatcaaagagctttgtgtagattcttctttggaatattgtacactggagaacggagatatcatcagtgtgccggcggtcacactttctaacacgggtttatactataactcagcactgtactcaccggagaaaacagtttcatccatgacaatggatgaatttatcagttctcttggtgacaacaaatttgcgctccagacagttgacaatgcatggacatcagcattgttattaacggcattgatcgcaaatgaagatggcggtaaagaatggcttcaatcgaatgaaggaaccaaatgctacgattacacagagccggcattcgtaaatgctgtaacaaaattaacagagatctggaaaacaaatgcatccgctaatgcagttggtgcagcatatgcagacgcagccaatgcattcatgtctgatcaggcagccgttatctgcaatggctcctggatgaactccgaattcgtggacagtgcttctgataactggtctaatggatttaacggagcggatgtaaaagcggattattatcctggcaatgtgtcaatctgtgaaacaaaagtatttggcagatggacgcttaccaatggtggtacggatgaagagagagaatgtgcagaagcatttcttgcatttatttattcaaaagatgagttagagacatttgcacttacagagggatgccagataccgaatcttacctatagcgatgaatttctttcgaagttagatgaaaaaccattggtaaaacagcagaccgagttactgacatctgatacaaatatcgttcctaatgtatcaaaaattatgcctgaatccgtatcaaacagtgtatttggaaccaatcttgtgcagttagtaaatggacagattactccgaaagagttctgtgagattcttacaacaaaagccgctgaagctggtgacaaataatcgatgaaatcatggagggggaatcatttacggacaaattgattcccctttttctttcagaagattgccttctggacgcggaatatatctgaaaataatgaatatttctgaaaggaaatggaatattatgacaaaaaagaaaaaatacggaaaagtgcaggttaaaaattttaaatggatttacgcattccttcttccgacaattattatatttgtgatgttttatgtacagccgatcgctgtgatgcttacaacatcatttacaaaatgggatggatttaatgctccttcttttaatgggatcagtaactatataaaactctttaccaacagtgcttctgcagcatcgatcaaaaacctgattttatggtcggctattgcaatgacgttccatgtaggatttggtgtgctcacggcatttgttttatatctgaaacctcacggatggaaattcacacgttctgtatttatgataccaaatattatttcagcagcagcgtgggcattgatctaccggtttattttcaatgaccagatgggtgttttaaactcagtgatacgtgtatttgataaagatttttcggtgcagtggttctaccagagtccatatgcattctgggcagttacccttacgtggctgttttatgcagttattgtcacattgatcgtattgaatgatttaatggcgattccaaaagaactgatcgaagcagcaaaacttgacggagcgaatggatggcagttgatccgtttcgtggaacttcctctttgccggatctccataggaaccggaatgttatgttctatcacatcacgtatctccatgtatgaagcgatcgcacttacgacagccggaggacctggtgatgatacgatgagtttatctgtactgctggtacgtgcgatcacagattacaactacggatttgccaatgcgatcggtgtgatcatgttccttatcggtttactggttatgtacattgtaacaaaggcattccgtatgaatgattcaatctactaggaggaacaatcatgaatgtgataaaaaaaatattaacaaatatcctgatttatggaacagaattcattgttattatgctgagtgtattcccaatcgtatgggtggcattatcctcctttaaaacgaatgcacagattctggagggaccatttacactgccaacaggtattacaacagcaaaagaggcatacacatatctgttccagaaatatgatttctttagttattttggcaattcgctgctgatatcgctgatatctacggtgatatccctgatctgttttgcaatggcggcctatgtattggcgaaatatgagttcccgggaagaaatcttatttttgcactatttacaattacaatgcttgttccgggtcatgcaaaagcacagccgattttttcgctgatcaattccatgcatctgtatgataccaaaacaggtttgatccttgtatatctgggaagcggtattgcaatgtcgattttcattttgaaatcggcatttatgggagttccaaaagaattggatgaggctgctacgattgatggtgcagggtttttccgtacattttttatgatcaatcttccacttgcgaaatcaggtctctctaccgctggaattttaatgtttctcggcaattggaatgaatatttctatgcagcacttcttacatcatcagagaagaacaggacgctgccggttgcattacagttttttaaccagtcattatcgtacgattacacgaaaatgtttgcggcactcacactcgtagtggttccggcgatcattgtatattgctttgcacaggagcaggtacaggaatctgttgctgcatccggaattaaaggttaataaaggagaatgaagctatgccagttatgaattacagaaaaggaacaggggcagagacaagctggatcattgaggagaccagctttcatgagaaatatactggaaaatgtgagtccatcttcacacaggggaatggttatttaggcctccgcaattcgctggaagaaagatatgtggatactgtcaggggtatgttcatcacaggaacattcaacaaagcaagcaaagaggaagcaactgaacttccgaatgtttctgatattgtgaatatggaaatcgaacttaatggtgaacgtttttccatgacagaggacaatctaaaagagtattcaagaacattaaatctttatacgggggaaacctgccgtaatgtcctgtgggaaggaaaaaacggggatgtcgtgcggctgtctttccatcgttttgtgtcttataagaacgtacatgtgatcggtgcatatgttgagatcaaacctgtaaactgcgacgtaaaagcaacggttgtgagcggaatcaacgcacaggtgaccaataatggtgcccagcatctcacggaagtatcaaagcgtgcattcgatgaaaaatatctgcagatgggaatggtcacgacagaatcagaagttgcgatcgcagtcagtactgttcatgacgtatttttggatggagagaaaacagaggagaccgcatataagatcgtagatgacagaagaaagatccatgcgaagatccaactggatatcccgaaaggagagacggcacgtgtagagaaaatctcaacggttcattccagcagggatcttgagtatacaggatcgggaaaagagccggataaagagacggtatatgcaaatggactggagaacttaaaggaagcagaatgcaagggataccggacactcctgcaggaaagcagggaagtctgggaagcaatctggaaaaaacaggatatcgtgatcgatagcagggaagacgatgcgcaggtggctgtccgctttgcattatatcatcttcagatcatggtgcggaaagaagacaaccgggttggcataggagcaaaggcactcagcggagaaggctacaagggacattcgttctgggatacagagacttttattttcccgtatttccagatggcagagccggaagtggcaaggacacttctggaattccgttataagggactgtatggcgcaagaaagaaagcaaaagagaacggctataaaggagcaatgtatccatgggaagctgcgtggatcagtgatggggaagtcacaccatatatcactggagtaaatgtacatacaggagagccgctgatctgcctgaccggtgtgatagagcagcatatcacttcggatattatttttgcattatggcagtattatacagcaacaggcgatcaggatttcatggacagatatggatatgaaatgataatcgagaccgcacgtttctggaacagccgtctggagtggattgaagaaaacaacagatatgaaatccgtgatgttataggaccggatgagtacaaagaacatgtggataataatgcatatacgaattatatggcacatgaaaatatgagactagcagcacaggtaattgcatgcatccgtgatgagaagaaagatatctacgggaaaatgcagaaattaatgcaggaagagggtacatcattagaacagttagaggaagaactgaaagataaaatgaagaaactttatttgccgcagccggatgaaaaaacagggattattcctcagtttgacggatactttgatctaaaagaaatagatctttctgtgtataagaatgcttctgttgtgggaacgatctttcatgattattcaggggaagatgtacagaaaatgcaggcaggtaaacaggctgatattgtagaactgctgtatcagatggaagatatcacaacaccggataataaggcaaagaactatgtatactatgaagcaagaacactgcatgattcatctctttccaaggcgatccacagtatcactgcatgtgaccttggtatggagaaagaggcttatgaaatgttcatgagtgctgcacttaccgatcttggacaggagatgaaatcctcggatgcaggaatccacagtgcaaatatgggaggtgtatggcaggatgtggtaatgggattcggtggaataagaatccgtgacggtcatctccgtattgctccaaattgtccaaaacagtgggaaaaatttacatacccgatttattggaaaggaaataaacttgatgtcacagtctgcaaagatggagtggaagttatcaacgagggcacagctttcatggcagagatcatgggacagatggttactgtagaaaaaggaaaaaacgaatttttggcataagaacataggagagaaaaatgctgcagaaagatggaaagtttgtcaaagtattgaaccggatcgcagatctggttggattaaatctgttagctatcctcttttgtattccgattattacgataggggcatccataacagctgtttatggatgcatctttcgcatacaggaaaaaagagagggatatctgacaaaggatttttggaaattgtttaaagaatgtttcaggtcatccacgatcatttaccttgtgggtgttgcagtcgttgcaatgttatatctggattatcagatttttgccacagacagcagactggacattttgcaggtacttgtggtcgctggcgggatattagtggcagagatttttacttatgcgtttccgatggagtcttactttgaaaacagcctgaaagcgaccgtaaagaatgcgttattgcttggaatatccaatattccatacacgctgctgatgctgggcataaatgtttttccatttttcttggttgccagaattccagttacatttggaatatggtttttgatcggcatttcaggggttgcatggatcaacagctttttcttaaagaagattttttcaaaagtcaggatacgaaaggatgtataacacatgatgaaacaacagttcatatgcgatagaaaaccaaaggcaagaccggaaaatgtgatcacaggagcaggatattgaattacatttctgacagacaggctggtcagatttgaatatgacagatccggtgaatttgtagatgatgcatctcaggtgatctggtacagggatcttgaggatgttccgtttgagataagacataaaaaagagtatatggagatccagacgaaaagcttacggatacggtatgatggaaaaccatttgaagaaagtatccttagtgtgaggttgagaaaaccggacaacggatgtgatctcgaatggtattatggaaagaatgaagaccgtaatctttttggaacggcacgcacacttgacgaggcaaatggcagcatcccgctggaaaaaggcattctttccagagacggatttgcagtgcttgacgattcaaaaaccattctgctcacagaagacggatgggtgaaagagcgaaagcagacaggagaggatttttatctgtttgcctatgggcatgattaccgaggggcggtgagggatttcctgagagctgcagggcgagtgccgatgctcccgaaatatgcactcggtaactggtggagcagatattatgaatattcacaggaagagtacaaaaaactgatggatcgttttttgaacgaagaaataccgttttctgtagccgtcattgacatggactggcatataacagatattgatccgaaatacggctccggttggaccggttatacatggaacagaaaactgtttccggatccaaaagcatttgcggatgatcttcatgacagaggaatgaaagtgacgttaaatgtccacccggcgcttggcatccggggaagtgagagcatgtatgaagagatggcagaggcaatgggagtggatcctgcaaccgatgaaccagtcgagtttgacatcacaaatccaaaatttctggaaaactattttgagatcgtgcatcacccacttgaggaggatggcgtggatttctggtggcttgactggcagcaaggtggtcatacagcagtgaaggggctggatccactatggatgttaaaccactaccattatcttgacagtggccgggatggaaagagaagaatgacattttcacgttatgcgggacctggttcacacagatacccgatagggttttcgggagatacagttgtgacgtgggagtctctggatttccagccttattttacagcaacagcatccaatatagggtatggttggtggagccatgatatcggtggtcatatgctgggaaacaggtcagatgtcatggaggcacgctggtatgaacttggcacattttcgccggtcaaccgcctgcacagcaccaaaatgtcattcagtgggaaagaaccgtggaatttcagaagcgaggtggaacaggcaatgggagaagccctgcggctgagacatcagttactgccgtatatctatactatgaattatctggcatacaaagagtaccgtcctctgattgccccgatgtattatgattatccggaaaatgaacaggcttatccggtccgggaactttcgtttgtggaaggagtaagcaataaccagtatctttttggaaccgatatgatggtcgcaccgatcacaagtgaccagatcgatattttgaatcaaggaaaagtaaaggtatggataccggagggatgttatcatgatttctttacaggactgatctataaaggcgaaaaagtactgtggatgttccgtgacctgaacagtataccggtgcttgtaaaggcaggagccatcatcccaatgcagaaagaattgtttggaaaggattttctgaagaatccggatgaactcatcataagagtctatggtggagaagatggacattatacacattatgaagatgacggagagacagaagattacagggacggaataaattgctgttttactgaaatgcgttttgattgggaaaacggaatatttacgattgaaggtgcaaaaggacagaaagatctgatcccggaaaaacgtgcatatacaatcgatctgtgtggggtaaaggaatcggttcctaaactatacgcaggcgggaaagaagtggaagtcaaatacgaatatgagccgaagatgggatgtgtcagaatccatattccgaaagtgtcagtggatgaaaaacttgaagttgtttttggacagaaactggcgttaaatgacaatcatacacttgagcgtgtgtatgacctgctgaatcaggcgcagggcagtaatctggcaaaagagtctgcataccagcttttaagaagtggaaagaatctggcagatatcttaggagaacttgaaacgacgaatttagacaaagagatcggacaggcagtcatcgagatcatgacggctgatttgtaaggaggaatgaagatgcagaaagcatggtggaaagaagcagttgtttatcagatttatccgagaagttttatggatagtaacggagatggaatcggagatcttcaggggatcataaaaaaattagactatataaagaatcttggtatcacagttatctgggtatccccgatctataaatctccaaataaagataacggatatgatatcagcgattatcaggctataatggatgagttcgggacaatggaagattttgatgaattattaaaagaaattcatcaaagaggaatgaaactggtaatggatctggttgttaaccatacatctgaccagcataaatggtttctggaaagcagaaaatcaaaagataataaataccgagattattatatctggaaagatccggtagatggtcatgaaccgacaaactggggatcatatttcagtggatctgcatggcagtttgatgagacaaccggacagtattatctgcatcagtttgtgccggaacagcctgatcttaactgggataatcctgtggtaagaaaagaagtttttgatatgatgacatggtggtgtgaaaaaggcattgacggattccggatggatgtgatcagtctgatcagcaagccggaagaatataaagatggtccggtaaaagaaggggaaaaatattccttttgtggtgcattcacagcaaatggacctcatgaacatgaatatcttcaggagatgaaccaaaaagtattaagcaggtataaccttctgacagtgggtgaaacatcatgcgttacgctcgaagaggccaaaaaatatgcgcgaagcgatggaaaagagttgagcatggtattccagtttgagcatatggatgtggattcggatgaacatggaaagtggacggataagaaactttatctcccggatcttaaagagatcctgaaccgctggcagaaaggattggaaggcgttgcatggaacagcctgtactgggacaatcatgaccagccgagagttgtttcaaggtggggaaatgattccgaagagtacagggagatatcggctaagatgctggctacctgtctccatatgatgcagggaacaccatatgtttaccagggcgaagaacttggaatgacaaacatgcgtttttcgaatctgtctgaatgcgatgatattgaagaaaagaatatatatgtagatcttgtcacagatgcaaaggtgtacacacatgatcagatgatggatattatcagcaggaaagggcgcgacaatgcaagaacaccaatgcagtgggacagctcagaaaatgcgggatttacgacaggaacaccatggtttggtgtcaatccgaattataaaacgatcaatgcagctgcgcaggtagaagatccggagtctatatacaattactataagaaacttatacaattgcggaaacaagaagaagtgatcgtatatggaacgtttgatggtcttgaagatgcagatgaaaacttatacgtttacacaaggactctgggtgataaaaaattactggtaatctgtaacttcacagagaaggaactggatgttccggtttctctcgcagatatggtgaaagaaaatcaggggattttagtggggaactataaagaaagttcagaaaaaatacgcccatacgaagcggtggtgtattgggtaaaataagaaaataaccattttgcggggattgcaggtatgtagggaatgataagagaaaaagatgatttttaccagaagatgttccggttgtcgataccgatcatcattcagggactgctcagtgcggcggtgaactccgcagatgtcattatgctcaattatgtcggacagtcttccatttcagcggtttccctggcagcaaattattcaaatatcctttttatggtgtataacggactgggtacaggtgcagcattgctatgtacccagtattttggaagaaataatatagaagcgatccatattatcgagggaattgctctccgtttttccataatcatttcggcacttacgtcagtgatcgcatttacgatgcctgggcgtatgatgatgctgtttacaaccgatcaggagctgatatcaataggggcttcctatcttcagatcatggggatcacttatctgtgctggagcataacagagatgtatattgcagtgcttcgaagcgttggaagagtgacagtatgtatggtcttaaatatattggcatttaccctgaatgtgctgctgaatgcggtatttatctttggattgtttggagttccgcaaatgggggcaacaggagttgcgattgcgacagcagtgtcacggtcagcagaactggcagcgtgtgtggttgtttctgctttcagcagggatgtgaaactgagccttgcatacatgtttgccaaaaatcaggcattgtatacggattttatcaaaatgtcattgcctgctttgggaaatgatgtgtcatggagtgttgcgttctccatgtattctgttattttaggacatttgggaacggacgcagtagcagcgaattccattgtttcagtggtgcgtaacattggaacggtattttgtttttccgtggcgagtgcgggaagtatcctgctgggaagcatgatgggaaaaggagatttggaaaagtcaaaattacatgcatcgaaaacattgaaggcgacagtgatcgccggagcagttggaggaatgatcgtccttgcagtgacaccatttgtacttgagtttgcaaccctgaatgataaagcaatgcattacctgaaatacatgttgtttatcaatgcatattatatcatgggagcagcggtcaatagcgttctgattgcaggagtattcagggctgggggagacactaagtttggtctggtctgcgacacgattgacatgtggctgtatgcagtgccacttggttttattgccgcttttatattaaagcttcctgttatgtgggtatattttttgctgtgcacggacgagtttgcaaaatggccatgggtgatacatcactaccgcagtggaaagtgggcacagaatatcacaagagaggatgtatttgcagaaaaagctgtattcttgagccatacagatataaaatagaaggcgatgatataaaatgcggatgaggtaaaggtatgtatagaatagggattgatttaggtggaactaatatgaaagccggaatcgtggatgaaaatcacaagattgtgatacaggattccataccgacaagagtggagcatccatataaggaaattatacgggatatggcggaactggtaaaagatttattaaaaaagatacatataacagaggagaaactttcaggtataggagttggaagtccgggaactgtagatgccaagaatggtatcgtgttatattcaaataattttaactgggaaaatataccgcttgcagaggaactgggaaaatattttgcatgtaagatcagaatttccaatgatgcaaattgtgcagcactcggagaggtaatggctggagctgcaatgaaaataaagaatgctgtgctgatcacacaagcctgatttttggaggagaacgctgtacctgtggcagaagaggatgcgcagaggcatatgtttctgctaccgctctgatcagagaagcaaaacttgctgcaaaaaacaatcctgattccattatgaatgaattatgcaagggagatctttcgaacatgaatggtaaagttccatttgatgcagcagagcagaatgatgcagcagggatcaaagttgtgaatgactatatcatttatctgggtgagacaatcacaaattatgtgaatatcttccgtccggacatagtattgttatcagggggtgtatgcaatcaaaaagagaagcttacggagccattgacggaatatataaagacccagtgctttggaagagagaaggcatatgtgcctgaagtacggtgtgcaattttaggaaataatgccggtattattggtgctgccggtttgatcgcactcgtatcttaatcgggataattgagccgtctgcacaatgctggcatatgagaatcagctgtttatatgccagacgctttaaaccatcagttgaatgacataatctgccatccggtgtatgcttaatgaaggaaaatagacatttattgaaaccacttttcattcagatataataggaggattacattatggaactgacattgggagactttttaaagattatgtcagcaagtgaagcattgggaatccgtgtgactgagaatgaagaataaaatactggcggattcactgaaaaggtgctaggatgctactactacatattaaaacggcagataaataagggggaagcgcttatgaaaccgatatatttgtcgatccagcaaaaagaaacaggagaaaacattcggagactgttgaaaagcaatgggtatacggtgaaagatgtccaggaagtcatgggattcgagaatccacaggctgtctataaatggctttccgggaaatcgctgccaaatctcgaaaacctcctgatcttaagcaaattattgaatatcagcattgagaatgggcgtgtgaaaaaacgagagttttttcattcgtccttttgcttatagttataataatagctatattacataaaaaagggtatagttccccttaccccataagaatgatattatgaaatcttatgcggcagctgcaacttttttctgtttgttgtgatatttataaagattgtgtccgatagaaacgagaaatacttcaagcaatacagattttattcctcttcggacaattcttttgtaccaccggtcgtttttcatgataccaaaggtaccttctgcctgaatggatctgttcatccttagaagcgctccctggatgctttcgagattttctatcacttcctgatgcatcgctgtaagttcgcggttgatccgtacagtacggtttttatctgtctttttacattgttctgcatatggacagccggagcaatcttcacactgatacacttcttcctgacgcccatacttgttcccttttacgttttttcgatactgaagataaaagcttttcccatttggacaacgcatgattccgccttccccgattggaaaatttactgcacgaaatggatcttcatgatacttcttgtctgtagtctctttcttgaacatggtaaatttcatatatttttccattccatgctgcccacagaagatgtaattgttgtaagaaccatatccagcatctgctactgggtacttcggataaaagccatatgtagtataaaacttgttcattaatggaataaaacaatccatatctgagcgatactgatttacatcaacaacagcaatatattcatctgcaataccgacctgtacattataagctggaagcaactggtcattgcccatgtagtctgtcttgattcgcataaaagtggctgaatggtctgttttcgagtaactgttgcgatcttctccacagattttgattttttccacgtattcttccaacttagcagcatactctttgagtttctcataatgacgttgttgtgtagttttgcgatgtcccctgccatgaacaaacattgcttcattaatctgccagacttctgcatactgttcagcagcttccttcagatactctggtgcgtactcactattgatacaaagtttcatacctgtacatgaaagttcctcattgatttcctcaaagagtgtagttaccttaccaaagagacggtatctggatttttcggttgcttttttccatacccaggagtatttattcgcatttgcttcaaacttggatccatcaatgtatagatgttgaagatctacatgctctgtctcgaagatttttttgtttatatcttgaaatatttcttcaatggaatcagcaagtacttcgttgatgaagtagccgaaagtacggtaagaaggtgcttgatgatccataagatacatgaagcggagattgactttacactgatcctccagttcacgcaatgatatatagccattcgccataaatccaaacaaaactgttttcagcatgctgaccgggtcatatctgagtcttcctgtataatgttgaggaatatttttcagatatttctccagttcgatttctcccataaatctatcaaaagtcagcactggatcacagatgtccaaataatcttgaattagcattggcaaaactgcctgttttgggttagaatagattatgttattaatttttttcacaaattaattataacagaaagaaagaccttgagttcattataaactcttggtctttctttttttcgggactattcttttttcacagccccattaatcttttatggagaattactatgcaagggatattgaataggataaatgatgttttggtgctgcaaaatggaatccgcaattatcgaatcagataagcgattatcgaatcagatgtgcgtttatcgactgagacggcaccaaaattgcaaatatcgactgagagggtgccaaaatttaaaatatcgaaaaaaacggcaccattttgagaaatatcgaagaaaacatacaccaaaatttaaaatatcgaagaaaacatacaccattttgaagaatatcgaaaaaaacagcaccataatttcatgtggcggcagacagtaaatccaattataattaacaatagatatagaaagcgaggggcaacatcatgaaaaagattattagaaaccgaatcaagtgtaaaaaatgtggtgagatcattgagagtaccagcagacatgactttaaattctgtaaatgtggagcagtcgctgtcgatggcggaaaagattatctgcgcagagtaggaagcaaagaggattatgaagaactggtcgaatacgaaggcagcgatgatgatgaagagtgagaatctgaggtttgttatggatgaaaccgggagaccttatgaaccagttgagcctgagtatgagagagcggtacaggagacaccggaatcgctggcatttgaggaagagttgattcaaaggtttagattacaacacgatgaggaataaattgagggaggtgcatcatgaatttatatattagtgatctgcatttcggacacaaaaatgtaatactgtttgatcaccgaccgttttcagatgtcgacacgatggatcactgcctgattcagctgtggaattcaagagtgtccgcagatgatgatgtttatatcgtgggcgacttctgttaccggtcaggacggacaccggactggtacttaagacaactcaatggtcacaagcacctcatcatcggaaatcatgacaaggcgacactggattgtgaaaacgctgcaaagtatctggagagcgttgaaaaaatgcaacatgtcacagatgaagacaaacagatctgcctgtgccattatccattggcagaatggtataagagccgtcatggatcatggctgatttacgggcacatccatggggcacgggatgaggtatacgaatttatgaaaacgagagagcgtgccttaaatgccggtgcctgcataaacaattacactccggtatcgttcaatgaattggtgcggaacaataaagcatttcaggaaaaggattcataaaatcgtagaaagaaggatttacaatgggaagaactgagaatataaatgtattccaagacacgatgaatctgtgtaaaaacaatgacagaatccgggaatctgttcataactcagcagaaggtcagaaattgattttggaaggggatgcgattgcggaaccagataagaagcgatacaaagagaaagcacagatcacagtatcgacaaagcgaacctttgaagcagcatccgtttataagggtacgaaaacagcagtacacaatttcgcatcggcttcaaatccgggtggcggagtggagcgtggtgcaaatgcgcaggaagagtgcttgtgcagatgttccgggttgtttaagtgcctgaatgctccggatgcgtggagtggattctatatgacacaccgggcagaacatgatccaatccacaatgatgatatcatttatacaccagacgttttggctttcaaaagcgataccgtaaagccggagctgatggatgaagcggattggtataacgttgatgttatcacgtgtgcggctccgaacttaagagagaaacctagcaatacctttaatacaggagacggaaaagatgcgatcaagattacagataaagagctgctggcgattcatgaaaaacggcttcggaggattctggatgtggctttgaatcatggagtcgaaacgattgttctcggtgcgtttggatgcggtgctttcatgaataatccaaatgtagtcgcacaggcatccaaaaatgttttgaacgaatatctgtatgcgtttaagaatattgagttcgcagtatactgtagtccgaaggatgacataaattacaggatatttgacagggtgttcagaccgtatacaaaataagaagagacggatataacagtgtttacagaaagcgggtgagaacggatgcattatgtaatcggggatatacatggctgctatcaggatatgatcgcattattaaataaaatcgagtcacaggatcaggatgcacagatcatcttcgttggcgatttcattgaccgcgggccggacgtcgataaggtgttggagtggtgtatggagaacattaaattagacggaaaatataaggcggtccgaggaaatcacgagcagatggtacttgaatggtataaagagtttatggactggtatgacaatgccggtagttattcgagtcgggaaccaatgcctgaaacctattatgatttttcaaggtggatggacgcgatgggaaaactgtcaccggatggattgaaaccatatattgatttcttctcacatttgccttacaaccggaaaatgacagttgaaacagcatccggaaaaacagtggattacaggatcgtgcacgctttttatgagtatgatgagggagtaccaaaattagagcaatattatacaaacctgtatgcaagaaaatatggcaattataagagtgatgagatcgttgtgcacggacacacgcctactatcgcattggcagccgaagattcgttaacttataatatcagacccggtcttattagttatcacaaaaatgatgttaacgtggattgcggctgcgtatacaaggaggcttatccagagaatccggttatgttgggcgccttttgtctggaaacttttgaggaaatatatgtaatgtccgttaaagaacggtttctggagaacggcgccggagatgggatgagtaaatacgaggattacaagcggaagtatctggcacaggaaagccttgagagaatggcattgttggagatgtatctataagaaatctgaataaacagattccctgtcttgggaaagtaatctgaatcggatagattatcggtgacgatttttaatatgatccatgctttccgagaataatcgtgtattgccagctgcgatatcatctataccatttttgagttgactatataattcaagccgattggtcaagtcctgataggtttcaatactcatcgcaaccagatcaattttctcatcatttgtaataaaaacgggttcatgatgtttatgacaataagctgcgatatcatcatactgattgtgtaattcatcaatggatctgatttctgacataaagacacctcctcgtctgataacagaattatatacagatttcgttatcaagtcaaaagaggattataggaagatacataataaggaggagtaacagaatgatttggagaatagcacgacggaggcacaatattgtttttgtttttggcaaacaagcaaaagtattgagagaaatgctcgattcggcagtcgttccagataggacggcactcgaaaaagaggcagatgaatttgagcagtacatgttgaaaaagagagaggagacacttgctcgcagtgaaaaatggtagtgtgaaagcactatttgcaataaatataacaaaaataaactgaaatatgtaaaaaatgttctgatttctgacgagcaaatgaaattttgagccttgtttatatgtgtaaacagcgtgaggattgaatccttgcgaatacacgatacacatgtgaagagaggatgaaagagtatgacagagacagaaaatcagaatgtacagaaaccagaagaaatgaataaccagaataataacatcaaaaacgaaatccgacaacgaaatgctgttctgattaatcagcagaccaagagacagattcgggattggctggaaggtaacccatatcaggagttgttagagtatatgaagtcaagggtcatgggacaggaaaacatagctatcgttgttgccaatgtatataattatctaaagaatgtcagcattccggacacaggcatggaaatgccaacacacggtaattgtaataatatgattcttgcagcaccgtccggaagcgggaaaacagaaacttacagagcttttaaggattactttaaaaagcgcatccctgcacttcggctcaccatttcagacgtcagcaacctgaccgcaactggatatcggggagcggagccgtcgagcattgtggagccgtttctcggatgcggattggaacctattggaatcgtgttcatggatgaattcgataaaatctgcactccatcatacagcgctaatcatggagatgtccaccttgaggtgcagcataatctgcttacgctggttgaaggatcacgtgtggaaaccaagcagggatacgttaacacaaataagctgctgttcattggcatgggttctttcgatcagtttcggaaaaagagggaaaatgatagcaaggagccgattggatttggagcaagtggaagtgatgaaattatggaagctgaacatgcggctccgataaccagagaagatatgatatcggcaggcggttgttatgagttaatcgggcggttttcgtatgttgagaactatcattcgctggatcagaagacaattatagaaatcatcaagcagaattgtgagaaaattgcggatgactttgattgtgagattgagttagcagagccagcaatgaaggagttgtgtgatcaggcaaactcgaaattcggatgccgactgatagagagtatgattcgggatattgtgctaagagtttacagtgaagcacttgagtcaggcgagaatggagatgttctggttgtgacgattatcacgttgcaagaatatgaatatcgtttcagagcgtatgaagaggaagatatcccattcgaaaccactaaaatgacaggaaataacaacggatgtgatgcagatgataagatttcagttcagaaaatgagctttgaagagcgtatggaagcattaattcgggcacaaacgcaacaggaataagattggcggtacttattattagtaccgctgatgagataacatttgagagggatggcggtatgaaaagagtaagaccgtggcatggacgctggatgtcaagaaaaacggcaaaacgaatcaatgatatgtttgactcagctccgatgccggattatacacaaatgcataaggaagcggtagagtttaaaaatgaaatgttaaaactccgtgaagaggcacttgcgcgcggagagaaatggtaaggattacagagatttgggtgccggaaagctttgaaaaataaggctttatccgcagcggataaagctatttggtgacagattagtggatggtcacagcatgtgtaaacacagtgaaatcgttggtaagaatggggttttagataccgtaaagccttgaaatataaggcttttaccgcagcggcaaaagccattttgcgataaaaacggacaaaatgattactatgacaataaggaggaatgacactatatggaagaaaagcaacaggaaacagcagacaaaaaaacattaagacaagagataccagtttattctgaaaagtatggtgttcacggaaaagttttagactatggcgtagtcacaaaactcgtgttcaactatgatggaaaggatttagaagtcggaatacataataatccgctcatgaacacagattattcgcagactggacaacagattttggaatcctatattgagaatctgagttcaaaggatcgaaaagtcatgctgcacaactggtatatagaagaacatttatctcagaaaagcggtagatacgctcttgcacacggaatcgtgacagggcatacccggttgccggattccattttttgtcatacctccaagatccgagagacatacgtaaatgaagaagacgagcttgtgattttgactatgaatacggagtaccattgtcctttaaattcatgtgactggaataaacaagatcagtacccggatatgatttctgattatgagaagataaaggcagaatataaagataaggctttgagaccggaaatcgagccgggcaaggtactgctggtactttcgaactttagtcattattactttcattccttatattgcattccagaaggagctgaccaaccatgtgaatacagtggggacgcgcatatagggatgtttcaggacagctatctgatcgaagcagacaacggacggattgatttgaggtatttcccgcattttcagaatattgagttttattccgagcacacacaggggatgcctctgtttcttgaaaatgtaggggacgtagtgctgtatgcaaaaacttcggcaggaatgatgaaattggatccgggcgatcggaaagaggtcataaaagcaaacgcggaatctgaaacgctgagcttgccgaatggggatctgtatccggcggggattatagaataaacatgtggaaggcagagacaggagacccgatgataggtctccaaagtctttgctcttatgaaatttatctaggattcacatcatatccaacaattttaaaatcgtcatcatcaattggttcatatattggacgcacacgatagtatgtttcgtaattttcaacggaatcagattcagttatatatccacaatcattaaatatacctgaaacttcccaacatcggttataatcttctccatcccaaccagataatacaagcagtttaccatcagcttcaatgataggatagtcacgatcattcattaaagcacctacagcttccacagctatattatccatgttttcaattgattttaaaaagtttgttaatttaattgcaacttcagttgtattagtccagatgatatcaattgaaatctgaggccaatctcttaagcgtactgtatgacgattaagagtgggattaaagtagtatttaataggactgtacattccacgaaatgagcgagtcattaaatttgtgaaatcttcttgtgagctctcttgcgggaaatcatgaagtgcgttgatatttttgctgaattttgtcagtgcatcaattgttgtcatagtgaaatcctttctagtacaccagcattgctaacctataggaaaaaacgattagacaacaggtgacattttgtggtatttttattagttaacttaaatatgtgtgagtgaattgcaaaggaatgcatttttagtgcattccttgtgttgtaacaaaattatttatcattcataagctcttgaagtttatctttaatcagttctcgctgaagcatgtttacctgacgtgtgtttcgaccagcgtttttccagtcgttagccttccatacttttgaagaattattatgagaattaatccaggcatctctctctgcaccggataactcattaagtttcggaatcgtccagaagccagcccgatgtccgataatgcaggaatttaatacagcccaagccatgtcacgaactttggtctttgaggttttggtatcagatttgagccagaacgcatcccagtcgcttattgtacgcagacatggaatggtaacctttcgttcacggtattctttaaattcagcaacggaatggaaaggaacggttgtaaagttagcgatttcgtatgtagtgttttcaacagtaacagtgcttgaagaaaagctttttctgtcgggtttccgtttcatgtcgaaatccatacggatatgtttcacagtatttttgacaatgaaatcctttccttgaactaagtctttaaaggttgtccactcctcatttttatactcaactgctttggtacgacttaaaacctgtgtcgttaaccacagtctgtctttataagtgtcggagtcgtaaccggattttgtgctgttgtgagcgcacacgccttcgtattccttaccatcaaaaagcataggattcgacttacagtacaaagatacattcccgcgcgtcgtaaaattaatgagatcgtcctgacagtgtttgatctcccagatttcaggattcttattatcagttaagaataatcttgcctgttccatagaatgtctgaatccgaataaatcgagcgatttcagagtgtcttccggaacgtctgatataaaaccgtctgttgtgacggaacaggtcatgaatccgagagcgtggcattgattctgcgttgccaaaagcacagcgcgtacaattgatgtaatcatgcaggcggcaaccgggttggtgatcgacgaacaccccagattttccatctcgtctttatatgcactccaagtggatttctcaacaacattctgagctgtttttccgtatccgctgttcaccatggtttttaagatgagttcctcaagagatttctttccgtgctctgctttagctttatcccggtctgccacaagttgctttacagcggaacggagcgagtatgacattttaccgttttcaggattaatgatcgcattcaaaacatatccctgttccacaaaaaccttagcaccgagtttcaatgccaaaaacagctccggaccacaagcgtaaacaccatcaataccctctgatgtggacggataaatcggtaccccttcaacgttgaccgggatacatggatatttaacggtttccgggaattcaaatcgaacatagcagaacatcatagttaacgatgcatatccaccagaatccgggttcacaaaatcctgtaaagtaagttctcggttcacgatttcagatttaatcggattctcccagtcgacatctggaaccaagcacatacaggttggatacgcattttttaagtcatagtcgaatgtggtttgaaaaaagtatccaatgtctgaacttccgttgtatccgccatggtaggcctgtgatgcataatattgaatcgtgttcgccttgtctgaaataggttcaagactggaactctcaacataacctggtttattaggtcttttgaccaatccgtgtccaatcttttcgagaccacggtatttacggtcaaattcggcagtattatcacaacccagatatgacatcatagaatctttcataacgtgagcagctgcagatgtaatcgtcacaggtggtttgttattatagccgtagagcgcggattcatataataaggcgaccgtgctatcgttggcagcgtattcaaaatatttacatgggtcgtccataagaagctgatccatatgatcgataacaccttttttaagctcaattttgttccaaccaaccgcttcaccgagatcttttaaggatttcattttcgcaggtgcgtggcacatggtatccgccaaattgaattcgatcgggtaggtatgcggattacggctataagcatacttaggattcatgctaggagcatacagcctggttggttgcatggtaatcagaccaccttgaacttcagtacagtatttcaggatgtccttatttcgtttcccgctctggtcaaatccggaaatgtctaccttacctgtgtggcagagcagaacgaccggaatatgaggagtcttagaccagtcatatcggatacgagttttcttaccgtcaggatatggatatctgctgtgttcgagagcctccttatcagtaccatataatgtagtcgtgtaatcaccggtactaagattcttaccagtttgagattcatattttcggacttttctattatcggtacagtggtaactgaggctgtctaagatacgtccgattgcgagttccaggttcaaacggtatttctcatgttttcggataaagatgtattccacaagatcgtttccatcgattacagaaaattgccaggacaggaggaaaagatcagatttattcacagggtcttggtaataccattcgctatcaaaactgattaccaaagctggactatcaggtctgatggccgacaatgactgataattagaaaacgaagacagaaccggaagattattaccaggtctgataactgaccgatcctgttctttcgattttgttttcaatggtgtcaaatctttctttgggtttcccatagggggatttgacaccgtgtccggaaaagtctcgaaaccattgattttacaagctttggaccggtttgctgtatcaacctcatttgacgatttttttaaaatatcgtcattctgcatcatcagttttgaaagatttcgtcttctaatatagagatcaaatcttttgttaaaatcaatttctgaagactctccggtattgaactgtttccaacctgatgttttaactgctggggatataatgcttgtaatcgcttccagattcaattctttaagaactgtacctgttccttctgtggttaccgatttctggttatcgatgttgccgttctgcaatgtctgtaatgtctttgtgttttccatattgtgtacctatctcaccaattacagtgagtcctttctttgagtcgtataaaaatatgtgctttacgctcatgcggtagcggagaaaggaaacctcattgaactgacagtcatggtttgattcgtaatgtaatcaaaatgggaatcaaattctttttgaatcggttgtatgtagtccttcctcgcgttcgtactagaatatggacgagtaactaacagacaaataagctttttgaaatcagcaatctgattaaaatgttatggaacatgaactttttgaaataaatatgaaatacctgacgagttttcagaaatgtgagccttattatgtatgtaaaaacaaaaacacaacacttagtaaacgaaggagagaaaaattatgaaaacaatgagaaacgcattaaacatcaccgcagacaaccacgagctcgtcaaagccggatacattcagcttccggttccaatcacgatcacggaagaatggcttaattcaccgtcgcttttgtataaggaagagactaatcgggaacggttaatgtacgacttaagagcatgcgggattacagacactgactttgaaaaactgattggaaaaacgatatattcaatccctgatgattcgatctacaacgcatatctggaagtcacgcggcttgataagctgacggaacaggaagatatagcatatgaagacatgcagaaatatttatctgagagcgatgcctacgttgagcagatgactgaagcatattcgagatttagtgagatgctggttgatcgcgtttggaattactatttatttaaagaacaggtgaaattggatcgtctgatgcatgcgtacaaagagatggttgctgagtgtacagtacaggcgctgctgtttatttcagtcaatacacctaattttggtctcggaatctgtttcaggaaggattaaaactgagggagtacgaatcagagcatctgacaatcacaatcggttgggtgctctgagaataaaaaaaaggctgtaaacaaaaacagttggtttcctttacaccgggagaagcactatataaataggaaaagataccgatttctgtaaaagatattcagtataccttttcgttaacacttaggaggattacatgatttacggatatgccagatgcagcacaaatgaggaacgtcaggatattaacaggcagaagagggaactgtatacattgggcgtcacagatgagaagtatatatattgggaatacgaaagtggaatgaaggatgaccgaaccgaattcaataagttgctggatattgtctcagaaggggataccattgccacaacagaggtgtcccgtcttaccaggtcaacgaagcacttatgcgagatattacagacggtgaaggataagaagctgaccctcaacatcggcggctcttttgtggtcgactgctcaaaaggagaacttgatccgatgacagaagggatgataaagatgtggggtgtctttgctgaaatggaacggaatataatttcccaacgtgtgaaatcgggtatgaaaaatgctagagcgaaaggtaaacagattggaaggcctccgataacgatggacagattgcctgacaaattctggaaatattatcagaagtatcaggctggggaaatcaatgtgtcggaatttgcgaggctgttgaaatgttcgagagtgacgatatataaatatctttcgatggtagaataggattggaataaaattgatggaaagcttgcaaaaaagtttatggaaaattcagttgattccgtgcagactctcacttataatgatattgaggcagagagccttttgaggaaactgaaaggtgctatgcacagtacaaaaggaggaatgccgacttgaataccgaaataacaaatgctgtgaatgcagcgggagacaaagcacagtatgatgcccgtgttaaaaggatattagcacaaaagaatattttagctcacattctggtaaaaacggttgatgagttcaagggaatgaagccggaggatgtagtaacatacattgagggtgagccaaaagttgggattgtaccagttgaaccgggattgtctaatatagaaaaaacagatgccacaggacagagaatcgtcggacttaacacagagaacgccgaaatcaatgagggactggtcagattcgatattattttttatgttcgcatgaaaaatggactttcccagattattgtgaatgttgaggctcaaaaggatgaacctactgaatataagatattaaaccgggcaatcttttatgtgagcaggcttgtatcatcacaaaaagagagagattttgtaaacacgaattatgatgacataaaacaggtattcagcatttggatttgtatgaatatggattataatagtttaagccatatacatcttgcgaaggatgagatgctgagtccatatgactggaagggcaatatggatctgttgaatatcgtgttagttgggattacgaatgatattccagaacatgacgaaaactatgagatgcatcgtctgattggggcacttctttcaaccgaattgagggagcaggaaaaacttgatattatagaacatgagtataatatcccaatcagcaatgaattaagagaggatgtgagaattatgtgtaatctgagtacaggcattgaagaaaaagctacagagaaaacaagcgaaaaatttattctgaatatgtataagaaaggttatacattagatcagatcgcagatattgcagaaacaagcgtggctgctgtggaagcagttattaagaagaaagagcctgcaatggcataggcgacaagtgaatacgaaaagaattaggcagtagatcagaaatgatttgctgcctttgcttttgtggaaagaaagatgagtgatattaatttatacttgtataatttttgatttaagagtattatcagaaaagattgcagacatcgcataggatgataacgtgttgtgaacattttgtttactttggaaattgaaagacgcagacccttgattttactgggttttaaattacgtaaatagttcgaatcttctcgcgcacgtatgctaaatagtcttaaattcttgaaaaatcaagggtttagggctatttttgtatatgcagattttatgaatcctttttaatgcggaaaattccataagatggtataataaaaaagataaattactggaaacaatgaattaaggtaaccttaaggttattcgagttggaaagtaagatttacgtgttaagatggcatcatcaaagataagaggaggaaaaaatatgtggacgagagcggaattaaaagacagagcaaagtttgcatttaaaagaaactattggagaagtgtgctgatcagtttactgctggcgcttttgataggaggcggcagtggcgcaggaagtgcaggttcggctatgtcatcagctttaggaagtgacggaagtgatattacctcggactcctatgatgatttttatgatgacgcagatgacatctggtatgggatgaatgatgtctatgacaatacagatcatacagcacttctttttgcaggagtcatttttgttgtgatctttatgattgtatttgtgatcattatgactgttacaattcttttggatgcatttatttttaatccattggaagtgggatgtaaacgtttctatttaagaaacctcaatgaggcagctttagtgggaaatgccggatacgcatttgataacaattataaaaatattgcaaagacaatgtttttccgtgatctgtatactgttttgtggtcaatgctttttattattcctggcattgtaaagtcatatgaataccagatgatcccatatctgctggcagacaatccacagatgacaaaagaggaggcatttgcagagagtaagagaatgatgcagggacagaaatggaatgcatttgttttggatttatcattcattggatgggatattttatctggaatgacaatgggaatcctgggaatcttttatgtgcagccatacaaagatggaacacatgccgcattatatgaagctttaagatacagaactccgtatcagcagattcagaatccggcaccttaccagcagaatactgcaatgaatcagcagacaacagagatgccgaatagatttgaaaatcagaatatcgatcagccgtttgaggacagaacggattattaggagaacaactacggatggattacaaaatcttgatcgcagatgatgagccggagatcagaaatcttctccggctttatctggaaaatgaaaactatcatgtaatagaagcggaggacggacagcgggcgctcgatttattgcgggcagagcagccggcattatgtattttggatattatgatgccgaagatagacggctatcatgtattgcagcagattcgcaaagagagtaatattccagtgatcattttgtcagcgaaggacgcagattcggaaaaaatcctgggattaaatctgggagcagacgattatctggcaaaaccgttcaatcctttagaggcagttgccagagtgaattctaacattaggcgtttttattctcttggaacaaaagtggttcaggagggaaatttagctgttcgggatctggtattgaatcaggacgcgtgtactctgaaaaaaggagacaaaatcatacagctgacctctgtggaatatcgcatcatggaactgttaatgaagcatccgggcaaagtctttacaaaacagcagatttatgaacatggatggggggaagattatattgtggcagacaataacattatggtctgcatcagtaagctgcgggcaaaactggatgataatccttccgcttatattcagacaatccgtggtctgggatatcgcttggagaagtaaatgaagaaacagaatgatttacagtggtttttgatcaaaaaatttattgaaatactagcagttgttggagttgtggaatatctgttgacttttctggtcaacagatttgtgctgcctaacgtactgctatatttttttccgggcgtggaagaaaatccgcttttgctcggctccggcgtgatcttcttcctgtctgcagttttaatgttactgatcttaggagcattgaatgcaatgtttccatcaccgcttcatgagatggtacaggcggctttggaacaaatgcaaaaaaatttcatgcataccgtttccgctggaaaaactaatttttctttttatgaattaaacagagggcaggcaattctgctttttctggttgcttttgtagtagtgttggtaattttaaccccgtatgtgttaggggcagtttgttttgcaaaaataacgattaaagagtttcgtcagatccagagagagagggaggaggaacagaaagagtttgaccgtaaaagaaatctgatgctatcagacattgcacatgatctcagaacgccgatgaccacggttaacggttatgcaaaagcactggcagacggaatggtggtggagccggagaaacagttggagtatttgcaggcaatacagaataagtcggcaaggatgaacgatctgatccatttattatttgagtatgtaaaattagacagtgaaggtttttcactggacagaaaagaaacagatctgagtgaactgttacgtgaaaatgctgcactcatttatgcagactttgaagatgcagggatggaattcgagattgatattccggaagaagtggtttcggtatccgttgattcaatccagttttccagagtgatcacgaatcttttgaataatgcaatgaagcacaatgagagtggtacgcatataaagattggcatgtaccggaaaaatggatacatttatattcttgtagcagatagtggcaggagaattccgggcgagcttgcggaacatttatttgaaccatttacaaaaggagatgtatccagaaaaagtggaagtggaagcggactaggactttcgattgcaaaaaaaatcattgaaatgcatggatttcaaatggattttatacaacagctggacgagaaaaaaattccgcagattgcaggctatacaaaagaatttgtcatccagatcgcggacgacagctacgactcatccctcacggcatgacgaaaagcgcagggcaataaaaagaaagctgcgcatatagacaagccggagggatttttatataatgaataaaaagtattgcaacaggaaaaaggagactctcattggatacatttgagatgttaaaaaggctgttaagccagaatgaatttgaacttttgctgccggatcagacaggagcaaaagaaaagaacacggataaaacagatattcgtctggtatatcagatgaatgacacgatagaaagctttcttgtttttaaggaagcaagaatgacaggtacatacaaagaagattatgaaggggctattgaggcctctttttatcgcgatggggatgattacgcacttgttgtccgacaggaagaggaggattgtgttgtcactatcctttttaaaacgctggagctggaaacaaatctgtataattatggtgatattgcgcatttttggagaaaaggttatgaaaatctgcggcaactggaatttcgtattgcggtattatgggataaatatgagtatcttggtgaggctgtctgcaatgaggaagaacgaaaactcgtgcagttagcctattttccacctctgaattatacctgttatccggcggtttcaaagcagtacattgtgccgcgagacaatccatggataccgtcggatggtgcattttccttgatgaaagagatggcagagcaggtgggtgacagaaaaattgaaaaatggatacatttttatgaaaggtatccatatcctgttgttgcaaggtgtcttgcagttttattacatcggaatgcgcatgcaaaagtagtggatctgatcacagagaggttaaaaaaagcgacatccgtttatcctaatcgatcttttggcgaaaaagaggatgaaaatatcgggaaacttttagggcgggcagaaaaacggaaagaagaattggagcgtgcgggaatccatgcggaggtactgcacgaagagccgtttacgaccgcaaaggatacgctggattttcatgtgtatgtcatgcaattgaaaaaaggcgtaataaacagaaaagttttgatcgaggaaatttcagaataatcacagaaaagaaagaagaattttgcaatgaacgaattaatggagcagattaagaaaaaagatgccagggcatttacgcatggaggaaaatttcatgcggatgatgtgttttcggcagcacttttattttatataaatccggaaattacgattttacgtggaaatcgtgtgccggatgatttcgatggaattgtgtttgatattggaagaggtgcgtatgaccatcatcagagggacagcagagtccgggaaaacggtgtgccatacgctgcgtttggattgttgtgggaggcagtcggtgcagagatccttggggaagagctggcagaggagtttgacgaggcttttgtgcagccgctggatcataatgataacacgggggagaaaaatgagcttgcaaacctgattggcaatttcaatccgacctgggatgcacagggtggaaatgatgaggcattttttcaggcagtaagcgttgcaggcatgatccttgaaaacaaatttgagcgttatcgcggaaatgagcgggcagacaggcgcgtggaggagattttagaagaacaccggcaggcggttacatctggtaaaagggacagcgaagatgcaaagattctgattttaccggagtttgtgccgtgtcagaagcggttgtcggagacggagattgcatttgtcatattcccatccaatcgtggtggatactgtatacaaccacagaagaaggaatattccatgaattacaaatgcagttttccggcagagtggcttggtcttgaaaatgaagaattggaacaggttaccggattacagagtgcaggattttgtcataagggaggatttcttatgacggtgggaatgttagaggacgcggtgaaagcctgccgtatcagcatggagttatatcatgaaaatccgacaatcgtaaatctcggcggggattcctgtatagatccgctgttaaagcagcttccgggaatgcaggaggcaacggtgatacatatggattttatgcagctcccagagcttacagtggatggaatttacggtgaagcagcgatggacaagcagcagtggaaaaacgaagtcaaagagaatctgaaacggattttaaaacagaagccggaggcagtatatgtggaaggaaatgtgtttgagacatatccaatcgtacatcagctgcggaaaaaacatattccagtattgacaatgatggaaaaagatggacagaaattaatcattcaaattccttccgggtcttaagttacaggaagataaaaagtagagaggagcaatttttttgaaaagtaataaatacgaaattgatatgtgcaacggttccataatggataaactggtttcgtttgcactgccattgatgctgtctggcattttacagttaatgttcaatgcagtggacattattgttgtgggaagattcagtggaagtgaagcgcttgcagcagtcggttccacaacggcactgatcaatgtttttaccaatctttttattggaatctcacttggggcaaacgtgcttgcagcaagattttttgctgccggacgcaaggaggaaatgtcagagaccgtacatacctccatcacgcttgcactgatcagcggaattctcatggcgtttgttgggcttgttttttccaaaggggcattggaattaatgggaacaccggaagatgtgatcggactgtcgacgctttatatgcggatttactttatgggaatgccgttttttatgctgtataattatggtgcggcgattctccgtgcagtgggtgacacaaaaagaccattgtattttctgatcatcgcaggagtgatcaacgcaggcttaaatatggtattagtgattgtatttggacttggagttgcgggagttggaatcgccaccgtgttttcccagatggtttcctgtgtgctggttttgacctgtctttgcagaacagagggaagttataaactttctttttcaaaactttctatgaaaggctattacctgaaacagatttttcaggtgggaattccggcaggcatacagagtaccgtcatcaatttttctaatgcattactacaatcgtcggttaattctttcggttcaaccgcgatggcaggttacacggcagcaaacaatattctgggatttttgtatgtttccatcaattctgtgacacaggcatgtatgagttttacaagtcagaattttggtgttggaaagtataaacgaatggaccgcgtactgatcgactgtatgattttatcggtgggagcagcacttgttttaggatgcggggcgtattttttcggagcggaaatattacagatttatacagaggaagcagacgtgatccaatgtggtgttgagattttatccatcacgacagttccatattttctgtgcggtattatggatctttttccgggtgcactgcgtggaatgggatattccgcagtgccaatggtattgtctattatcggaactgtcggaatgcgtgttctgtggatttttgcattttttccacagcacagatcactgtattttctgtttatttcctatccggcatcgtggattgcaacaatcgtaatgcaggtggtatgttactattttgtaagaaagcattgttataaatagggggaaaacgaaccaatgataatctgtaaaaactgtggggcggaatatgatgatgagcaggatcgctgcccttattgtggtggggataactttggcaaatctgtccaggtgcatgaggacatgatgaatgagctggaacgtgaaaaaaaacggtggaaggaaatgccggaaaaagtggctggcaaaggaatgtcgtggacagcaaagcttgggatagcagcagtgataatggttgcagtgatctgtatcattgtatttattgtttccagtatttcccataaagtatcttatcgggtagaacagaagaatctggaaaaattagaaagcctgtatcagagcggagattatgagggaatctgtgaatatctgaaaacagtggaatatacctatcagtcttattttgataaatatacagagattgcgggaatgcagcgttatttgaattatctgaatgacgaggatgattcttatctgcaatggatcgtagagaatgataaggcagatgcattgagcaacatcagttacatcgttagtatattaaatgaatgtcaggaggcagcggacgcatattacaagtatgaggaagaggatgctgtggcatattacaaagaatattgttatgattatatgaaggaacactacgagatatctgaggatgagataaagtcctgcatagataaagccggtgggttgacttacgatgataaagatcagattacagaagcgttacagaaacttgcaatcagccgattaaaagacaaaatggagtaaagtatatgaaatgttcaaagtgtggatatgattatccagccagagagacaaaatgtccttattgtggagagccaaataaacttggtatggaatgggaaaaggaggaagacgaaacaagaaaagaaacacttcttaccaaagcaaaagtgttacattccatgccgctttatgttgctaataaaattatgaatatcattcttttgctggcagttgtacttcttgttgttttatttcttgtctttttcattttaggctatgtggatgaaaagcatacagaacatcagaaaagatcagcatcggtagaagcagcagaagaaattttcaagacgggagataatgcagcgttggatgcgtatctgcatgagtatgaagtttatgcagaggacgggtatgaaaagtatacagaacgtgtagatatctatgatagatacagccattttatagaagatgtgatggatttaagggagaagtctgactgggaaagtgacaaaacgccaagggcatatgaagtggaagatatcctatactatgcgcatgaaattttgcttcaggatgattatcgtatcagtgaaattgaatttcaggaaaaccagaaatatttcagtgaaatccagcagaatacgattgcaacattaatggggactttggaaatgacagaggaagaagtgaatgaatttgtaaagtgcgatcgatattatgatgaggaggaaacttttgtaaaaataatttttgagagaaaggggtgggaatatgaagaaaattaatatcaccttttcttttcgggatgaaactggagattacagcgtaaaagtgttcccttttgttataaaatgcatagtgtcagtgatcgtggtatttaattttatagtaattgcaatggcattaccaggagaaatcagtgatcatgtgaaatattcaggaaaggaatattataaatcaaggtgtgaggaaaagtatattgacagggagtttgacagtctgcatgactatttaaatctgtatcatctgcagggagaagattacgggatttattgggagatggtaaacggttatgaggattataccatatatatgaattataaatccatggaagagcaggaaaatatatctttttcttatatgggaaagtatgatcagccgcaggagatttcctttataacatcgcagaaaatagaagagtatcgcaataaagtgttagaaaatgcagagaatgtgaaatatgagagaaataaaagatatttcacagagtttgcacagaaggcacagtgaaaattttaaagcagagacattttgcatcaggcagaaaagaggaaaaaggaatgggaaaaagatatattgactgttcagccagagaactggctgcctatcataaaaaagaattattacagtccattgcggacagcgaaggaagagtgcttgcagcagagacgatcggtacagtgacaccaatgctcgtaaatattacaaatgcagaatttgtaacttctcttggtgcggatattatcatgctgaatatttttgacgtggatcatcctgtgatcaatggattaccggaagttgccccggaagatactatacatgaggtcaaacgtctgaccggaaggatggttgcaattaatttagaaccggcggcagtccgcaatgatggagaaaaatcggtgtggagtcttaccgaaggacggcgcgcaaccgtggaaaatgcaaaaaaagcagcagacatgggcgttgacatgatcgttcttaccggaaatccaggtgttggcgttgataacagggcaattacaaaggcattagctgatttaaacgaggcagtcggcgacagagtgatcctgacagcaggaaaaatgcatgcatccggcattctctcagaagcaggagaaaaaatactgacaaaagaagatgctgagacatttattgaagcaggggcagatgtccttttacttccggcacctggtactgttccgggatttaccatggagcatgcagctgaattgatcaaaaccgcacatgaaaaaggtgtacttgcgatgactacaattggaacttcccaggaaggagcggacgaagaaacaatccgacagatcgcattgatgtgtaaaatggcaggtgcagacatccatcatataggagatagtgggtacatgggaatggcactgccggaaaatattacggcatacagcgttgcaatccgtggaaaaaggcatacttaccgcagaatggcgatgtcacttgtaagatgaagatagaatggtgattttcgacaaaaagaaatgtaattttttgcttgagtgaaaaagtaaattccgcacgtaaacttaaattccatacggaagactaaattctatattttagggtttgacgaaatgcgtcaaaccctttaaagtggaatttaaccagacattgtttgtgcatttactggaaaaaggcgtactgataaggcaactggaatcgtgccctgtaagactaaattccacttgcctggaggaaaaaatatgcaagactcttatccgcagattcatatgtaatgtctggttctatttttgtaataatgccggtgtcaatacaatctcatcatctggtatctcagtaagtccaaagtaatctattacctctgaaggcagcatgagttttgcaagcttcaagggtgacattccacccaggctctgccggggagaactgttgatatggctcatcatcagagtgatgtcttcctgagagtagtcatcaaaggaggtgcctttcgggcatattttacggatatattcatggtttttctcacaatgaggtttttgccaggaacacataggatcgcaataataaatgcttgtacgaatcaggttttcctgtccgcattccaatgcggcaggattccggaattcaccacctctgtctgtcaggactaaagagaatacagaggaaaatgaaaaagttcctaaggagcgttcgatagagtcaaaaatggcttttacatgacagacctctttactgtcgagaaggtaggccatcataagggaacaacaatcaaagtgaagggtaagtaacactttttttgaaccttcacagcccaggacagtatccatttccgtaacccttgtgtcaggaaattcctttaaaaaagcctggtagtctttgtaagtacgtccttcataaatggtcagatcggcagcttcagaagaactgcaggaacgcaccttatatttcacctttttaggaaggtcgatatttttcacactaagagctccggactcaatgtagttataaagagttttttcagatagagcaatttccggatgattgcggaggatcatgtaaggagactgcccctgcagaatgagaggggttaccaattcatccaaagcaacaaggtcagcaggcgaaatgttaatacctgctcttgattccacaaggatggttttatattgcctgtgtgcagtggatgagcggtagtaggctttatcgaggcggcagggattctttttactgcaaccattgcagacaaaaggggctttatccagcaaactgcaatggtaagattgaggaataaagtcctcgcagtgagagttgcaatgattgcaggatctgcacatccttttgcaaacaggggcataggtaccacaaatatttttctttttgcaatcttttgccaaagcacatttgttagcaggttcattaaaacgattgtgttcctggaaagacctgtgctttttgatttccttggagatggtggtgggatcttttcctaactgtaaggcaatggaacggagagacaggtgttgatccaatcctttctcaatggaaatacggtcatccagggtcatatgtttttgagtagcagtttttgaattgttcataaatacctcgtttctactgcagataggagatattaaaatcataagatagatctaagaagagagaaagactaaattcagcatagatgtggaatttaaaatttcattcaaggaatgtaattttttgtcaaaaaagatgttgacaaatgaattgtggtttgttattattaacgagttgtcgcaagtaagtgataacaaaccacttcatagcgaggcaaaataaaataaaaaaattgttgacaggcgcagatgattatgataatatatcagagttgctgaaaacaacagagaacattgataactgaacagtgaataaccttgaaagattctaaagcgaacaagtccgctcagaagaaatctccgatttcttccgggttacaaaaaagatttagttcgcgagtaataattcaagtcatcgaaagatgaacgaacagcttttaataaagcaaactttaaaaacagtaaaacctgaatcaagattccggtaggaacttgtttctgatttagaaaagccagatattctggtttggatttaactttttaacatgagagtttgatcctggctcaggatgaacgctggcggcgtgcttaacacatgcaagtcgaacgaagcactttaatcgatttcttcggattgaaattttagtgactgagtggcggacgggtgagtaacgcgtgggtaacctgcctcacacagggggataacagatggaaacggctgctaataccgcataagcgcacagtaccgcatggtacagtgtgaaaaactccggtggtgtgagatggacccgcgtctgattagctagttggcagggcaacggcctaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaaatgacggtacctgactaagaagcaccggctaaatacgtgccagcagccgcggtaatacgtatggtgcaagcgttatccggatttactgggtgtaaagggagcgcaggcggaaggctaagtctgatgtgaaagcccggggctcaaccccggtactgcattggaaactggtcatctagagtgtcggaggggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcggaaagcacagcttttcggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatcccggtgaccggacagtaatgtgtccttttcttcggaacaccggtgacaggtggtgcatggttgtcgtcagctcgtgtcgtgagatgttgggttaagtcccgcaacgagcgcaacccttatccccagtagccagcggttcggccgggcactctgaggagactgccagggataacctggaggaaggtggggatgacgtcaaatcatcatgccccttatgacttgggctacacacgtgctacaatggcgtaaacaaagggaagcgagaccgtgaggtggagcaaatcccaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttggaaatgcccgaagtcagtgacccaaccgcaaggagggagctgccgaaggcaggttcgataactggggtgaagtcgtaacaaggtagccgtatcggaaggtgcggctggatcacctcctttctaaggaaatcgagtagagattgttcactgttgagttattaatgaaagttaataacaaacggaagtttcgaagaaacttctaaagcatggagcgccaatgcgcgagatgcagttttctggtggcgatgcgcttttgggaaacacccgtccacatcccgaacacgatggttaagacgaaagcggccgatgatactatactggtgacggtatgggaaagcaggtggctgccagattaaaaaaagaaaatttactatattccaaatgggggtgtagctcagttgggagagcacctgccttgcaagcagggggtcaagagttcgaatctctccatctccattcggtcaggaacataaaactgtgtaactgactgtgtgtacattgaaaacttcatacagagataagtattgagaaaaatatctgtgaaaacatttatttaatcaagacatccgagaaaacaaataaccaaacgtaaacatagttgaaaaaataattacaagctttttaaaaagcagaccccatttcaaacgctattgaaatggtaaaagagaggtcaagcaaaaaagagcgcagggtggatgccttggcactaagagccgatgaaagacgtgataagctgcgaaaagctgcggggaggagcaaatatccactgatccgcagatgtctgaatggggaaacccgcatgagcaaccctcatgcatccatacgccaatccataacgtatggaggggaaccgcctgaactgaaacatctaagtagggcgaggaagagaaagaaaatttatcgatttccaaagtagcggcgagcgaaatggaaagaggccaaaccggagtgcgtgcactccggggttcggaccgcatttaagatctgatgatcctagcagaaaggttttgggaaagcctgccggagagggtgaaagccccgtaagcgaaaggaaagccagctgagcggtatccagagtacatcgagacacgagaaaccttgatggaatgagcggggaccaccccgtaagcctaaatactccttagtgaccgatagcgcatagtactgtgaaggaaaggtgaaaaggaccccgggaggggagtgaaagagaacctgaaaccctgtgtttacaagctgtgggacatctttacatgatgaaccgcgtactttttgtagaacggtccggcgagttgcggatgccggcaaggttaagcacttaaggtgtggagccgaagggaaaccaagtctgaagagggcgcatatagtcagtatccgcagacccgaaaccgggtgatctacccatgtccaggttgaagttgccgtaaaaggcaatggaggaccgaacgcacatccgttgaaaagggtggcgatgaggtgtgggtaggggagaaattccaatcgaacccggagatagctggttctcctcgaaatagctttagggctagcctcgttttagtcttatggaggtagagcactgaatttccgcgggggcgtcaaagcttaccaaagaatatcaaactccgaatgccatgtagatgatgaacgggagtcagactgcacgagataagttgggcagtcaaaagggaaagagcccagaccgccagccaaggtcccaaagtgtgtgttaagtggaaaaggatgtgggatctccaagacaactaggatgttggctcagaagcagccacacattcaaagagtgcgtaacagctcactagtcgagaggtcctgcgccgaaaatgtccggggctgaaacacaacaccgaagctgcggaattgcgaatgcaattggtagaggagcattcttaataccgacgaagctgtaccggaaggagcagtggagggataagaagagagaatgccggaatgagtagcgagagagaggtgggaatcctctcggccgaatatccaaggtttccagagtaaagctgatctgctctgggtaagtcggggcctaaggcgaggtcaaaagacgtagccgatggacaacaggtttagattcctgtaccgcatataaacagaactgtggggacgcatggggagagcatgggccgggaatggaaataccggtgcaagcgaaggaggtgtgcagccggcaaatccgctgcatgagccgaaagcgtgacgcggagcgaaataaaagtagcgaagcatgtgagccctgtgccgagaaaagccgctattgttttatatgtgcccgtaccgtaaaccgacacaggtggatgaggagagaatcctaaggccggcggaagaagtattgttaaggaactcggcaaaatgaccccgtaacttcgggagaaggggtgcccacgggagtgggccgcagagaataggctcaagcaactgtttagcaaaaacacaggtctatgcgaaaccgaaaggtgaagtatatgggctgacgcctgcccggtgctggaaggttaagaggagaggtcagcgtaagcgaagctttgaatttaagccccagtaaacggcggccgtaactataacggtcctaaggtagcgaaattccttgtcgggtaagttccgacccgcacgaaaggcgtaatgatttgagcactgtctcgacaatacatccggtgaaattgaagtaccagtgaagatgctggttacccgcgccaggacggaaagaccccatggagctttactccagtttggtactgggattcggtactgcacgtacaggataggtgggagactgagaaacttgaacgccagtttgagtggagtcgctgttgggataccacccctgcagtattgggtttctaaccagtcaccgtgacccggtgatgggacaatgccaggcggggagtttgactggggcggtcgcctccgaaagggtatcggaggcgctcaaaggttccctcagaatggtcggaaaccatttgaagagtgcaaaggcagaagggagcttgactgcgacaccgacgggtggagcaggtaggaaactaggacttagtgatccggtggcataaagtgggattgccatcgctcaacggataaaagctaccctggggataacaggcttatcactcccaagagttcacatcgacggagtggtttggcacctcgatgtcggctcatcgcatcctggggctgtagcaggtcccaagggttgggctgttcgcccattaaagcggtacgcgagctgggttcagaacgtcgtgagacagttcggtccctatccggcgcgggcggaggatatttgagaggagctgtccttagtacgagaggaccgggatggacggaccactggtgtatctgctgtcggccaacggcatggcagagtagccaagtccggaagggataaacgctgaaggcatctaagcgtgaagcccccctcaagatgagatatccctcacaaaagtgggtaagatcccttgaagactacaaggtagatagggcagaggtggaagtgtggcaacacatggagctgactgttactaatcgatcgagggcttgaccaaagcggagaaagacggcaggatgtaggaagtggcatggagcagacttttctgcggatatggcacttgatacagacggagttttgcgtagcaaaatcatcgagatgaagcgaagcggaatcgagatgaccggctttcaaaaacgtttgattcttggactttgtatgaagttttgaatgtacacttgcaaaaatggataagataagttatgatattaatggtttgaaataaaactataatatataggggattggtcaaatggtatgataggagtctccaaaacttttggtgggagttcgattctctcatcccctgctgatgaagccttgatttttcaaggcttcattttttacgtatcatatttttttgtgtaatccgtgaaaactatttagaaattatttatataatttagattttttaataaaaatctctcatatgaattgacattattatacaaaatatctacaataaaatagaataataaaacaaaggagagtttagagttatgattcaacagagaaacattgcagtatgtattattttatccatcgttacatgtggtatttatggtatttattggtttatcgttctttctaatgataccaatacagtatccaatgcggagaatgccacatccggaggagttgcttttgttttaagcctgattacctgtaacatttacggtttatactgggcttacaagcagggagagaagatcgacaaggcaaaaactgacagaggcatcccatcaagcaatagcggagttatatatttaattttatgctttgttggattaggaattgttgcagaagcattaatgcagaatgaattgaatagccttgcataagggttagaaaaataataaatccctgatagtctggcagaacgtcagattgtcagggatttattattatgccgtttgttggaagttcagggagcgtatgtgtgagcaggcgtaaaatataaatgccaaagacaatgataccgagcagacaagtgatgaacgtcagataaggcggctttttttcgaatatatatttataaaaccaaagataaagaaagtatggaatcagaagaaagatgcaggggttcatctgaaaagcagttgaaaaatgggctgtgagaaaactgatcccagcccgcgtgagaccacaggcaggacatggaaagcgaaataaaatagcaattggacagacagagtgaaagagatattgagtaacgctcatgtatataataatacaaaggattgcaatgcgattatggtatagatcggataaaaaatttttaattccttttaaaatgaacatatgatctccaaaatataaaaaacgatagacaaattataagtagtactctgattcatcataaatgaggggcaaaatatctcttgaccctcatatcataatataacatgaatggatatttaaggcaaaattgtatgtgattttatacatcgggaaactaaatgaacaaaattagtttctttaaaatatgtgcaaattgaataaaaaaatcgataatggaaaataatagtagtaaaaatagatagtgtagttttttaagagacgtgaaaccggaaaaattagttccttatctccggaattttacaaaaaaaatgatgaaaaatgacggaaaatggcggaatttgaagcaatgacggaaaattgacaaatgaagaaaatgatgtcataatgcgtttctgaaataggaagtaagtgtttttgataagaaagaaaggatgtttaaaatgattgaaagaaaaatcagattgactgacacagaagaggttaaggattttgtaagagctgccggaaaatgtgattttgatattgacgtctgttataatagagcagtaattgatgcaaagtcgttacttggcatgctgtatctgggaatctgcaaagatcttgttgtaaaatatggcgaacaggatgaatgttttgaacatataatgaacaaatatgcggttgcataacttccgctgttattaatttcactcataagtgatgtgttccggcataagaaaaggactatgtgggcaaaggtatatttgaaatctttgtctgcatggtctttttctttttttctatcagaaaatcagttataatggacagtatgagtaaagagaaaaaagggaaagagacagaaaatcaaatagaagaaaaaagaagccagatcaagatctcagtacgcaatcttgtagaatttattttccgggaaggagacattgacaaccggcatggacagtctgtttcaccggaagcaatgttagcagggagcagaatgcaccgcaggatccagaagcggatgggcagcgattatcatgcagaagtgccgctgaaattagtgatcggggaagaaaactatgaccttgtattagagggaagagctgatggaatccagatcacttcggaatcagaacgtgagattgattattccagtaatttcaattccatgacaattgaggaggatatgaaggttgtcattgatgagattaagggtgtctatctgaagctagagcagttggcagaaccggtcagggtccataaggcacaggcaatgtgttatgcgtatatttttgcattgcagcacgacatagagcggattggtattcagatgacttatgtaaaccttgatacagaggagatcaaatattttcatgaggattttacatttgcagctttagaagaatggtttgatgagctgatcagggcttataagaaatggtcagattttcagtatgcatggcggatcctgcggcaggaatccatacagaaactgcagtttccatttccttaccggaaagggcagaaggagctcgctgccggagtgtaccgcacgataaagcggaaaaagaatctgtttatccaggcgccgaccggagttggaaagacgatttccactgtttttccgacggtgaaagcggtgggagaaaatcttggagaccgtatcttttatctgacggcaaagacaatcacgggaacggtggcaagggaagcgtttgaattattgcgcaagggcggatatcaggcaaagattatccagatcacggcaaaagaaaaactctgtatgtgtgatgagatggagtgtaatccggtacactgtccatatgcaaaaggacattatgacagggtaaacgatgctgtttttcagctgcttttgcaggaagatgtcttttcccgggaagtgttgttagagcaggcagaaaagtatcaggtctgtccgtttgaaatgagtctggatgtggcatcctgggtggatgatattatctgtgattataattatgtgttcgacccgaatgtgtacctgaaacgtttttttgcagaggggatccggggagattatattttccttgtggatgaggctcataatctggtggaacgcagcagggagatgtacagtgcagagatttacaaggaagattttctggcagtaaagaagatcgtgaagcgttaccggccggggctggagcagcagtttaaccactgtaaccgcattttattggaatataagagggagtgcgaaaagtataaggtttatgacaacattggaaatctgatgttttatctcatgaagcttgcgtcagaactggatgagtttttacagcgcagcacagagttcccggagcggaaagaagtgagtgaattttattttggactgcgcaattttattaatatgtatgagcgcgtggatgagcattatgtgatttatacagagcatatggaagatgagcgttttaagatgaagctgtattgcgttgatccatcgctgaatctgcaggagtgcatcgacagaggcaattcggccatctttttttcggctacttttttgccgatccaatattataaaaatctgttatccacgaagaaagataactatgcggtttatgcggagacagccttttcggaggagcagagtctgttacttatgggaagcgacgtcagcagccggtatacaaggagaaaccaaagtgagtttgaacggatcgcacaatatatccaaaagaccggacttgcaaaaaaaggaaattatatggttttcttcccatcttataaaatgatgcagcaggtttatgaggtgtttcaggagctggatggaggtaccgtggatggcatcattcaggagccgggaatgaatgaggaaaaaagagaggaatttctcgctgaattttcggcagagagggaaaaaacattgatcgcattttgtgtgatgggtggaatttttggtgaggggatcgatctgaaaaaggaacagctgatcggtgcagtcattgtcggaacaggacttccacagatcagtaacgagcgggaaatactgatggattattatgaaaaaagaatgggcgaaggcttcgattatgcctatcgttatccgggtatgaataaggtattgcaggctgcagggcgcgtgatccggacgatagatgatgtgggtgtgatcgaacttttggatgaacgttttttacagagtgattaccggaatctgttcccgaaagagtgggagaaacgtctggtgtgtaccgttgacagcgttgaaacatatctggaaaaattctgggaagaaaaacaataaaattggaaagggcatatcagtatcagcttcaggaaaactgcatggatattgatatgccctttgttttatttcaggcaggatcgctttggtgtcttagcggtagtcgcccatgtagaataatgcaatggtaccaggaccggaatgtgcgccgatagttggtccgatgtgattgatcaaaaagttttcaatgccgagtctttttttgataagctctgcaacgaattgggcatcctctaaggaatctccgtgtgaaatgaacacgatgtcgtttttgtcacgccatgcaccgatctgcttttccatactgtcaacaagggcgatcagtgattttttccggccgcggaccttggaaagcgggatgaggtggccttcgttatccacatggaggatcggtttcaggttgatcatgcttccgactacagcagcggttttggatacacgtccgccacggtaaagatggaaaaggtcatctacagtaaagttatgtacgacatgcagtttattttcctctaaccatgcagcaatctcgtcaatactttttccctcttctttcatcatgactgctttgtgtacaaaaagtccttcgcccatgctggcacagagagagtcgatcacgatgattttgttgtcgggatacttctcggcaaggttcatggcagccaggcggcagctgttataagtaccgctcagaccggaagaaaatgcaatgtgcaggatgtcaacgtcctgtgttcggataatattttcaaaaagattttccgcttcctcaggatttgcctgtgaagtcgttggaagagaaccattgcgcatcatggcatagaattctttttccggaagggaatgttcccaggtgtaagtctggttttcaatcgtatatggaagagacatcatgccgagatgatgttcgttgacataacttgcaggaagatccgtcgtggtgtctgttgttataataaagtctttcataaagccgttcataaagcctccttgttttgcgattatctgataccattatataagattctatggagaaagaaaagaaaatcatgcaaattctaaaatatttataaatttcccaaagatagtttactttttgaaaaaaacaaagtatgataatcacatcttttttatcaaatcagtgttagttatcgaggaatatccctgcagatttttaggaggcaggaattttgagcaagcagaagataattggcatttttggctgtgaacagacggatttatgtatctatctggccagcatcttagagaatatgaagaatagtgttctcgtcattgacaattcatttgagcagaaaatgcgattttgcatcccaagaccaaatgaaaaaatgaatatgatcacttataaaaatgtggattacacagcgctttgtgagcgcagtctgtggaaaacagaaggttatgactatgtcattgtaaatttaggcagttggccagacgagaaaagtgtcacagattgtgatgaattgatctgtgcgctgaattgtgagaagtgcgagattgaaaagtaccgggaatttattttgcatatcgaacatccggtcagtgttttattccgggatttttgcaaaagttatatgagtgcaggaggaatcagaaaactttttgtggatgaaaactgttttgtattagaacagttgtttttgccattttctgaggctgacgagtgcagcaggctgatgatgcagtttgagggataccggaattttgcaaatttatcaaaggagtttgaaaaggtattattccacttgtgcaggaatatttcagagcaggattatagagaagttttaatgggcgtccgccgtgcaaaaaggggggaatgcttttgaaaattgtattctggagtgaggaagcggcgtgtggaacaacatcgaatatgatcgcaacggcaagcatgatcgttgcgagacataactgccgcgtagcgatgctttcagcggaaaagaatgcgcatgatcttgccggaaatttttccagaccggattctgtgactgtgaatgaagactgtgcttactacgcattagaagggttggattatctgttgatggctggaaaatacggtaatcttacggaacatcatttagaggaggctttacagtctgttgtagatggaaaacttttctgccttccgcaagggaaacggatgctctgcgatttttatccgaaggagacaagaaacgttttaaaccaggtgatccgtttgctggatgaaagtatggatttttcgtttattgactgtggaagtgaaagaaatgactggacaaaagagcagatgaagcaggcagatcttattgttgtcaatttcagtcagacatcccaggggttagatcattttttttcagagcatgcagatgtttcggagaaggtggtgtatctgatcggaagttatcagaaagatgctgtctataataagaaaaatattcacagaatctatcggattgcaccggagaagcttggtgtagttccctataatcctgagtttgagatggcatgccgggagggaaaattagacaggtatatccgtggcaggagactgttacttccgacagatatgagggaaaattttttcacagagttagagcataccgtacagatgatcctggagcggtctgataagaggggaggcgggcaggttgtcagtggaagagacaggcagtctaaaactgtttgaaggaaaacaacaggaaattacaagacaggaacttgtggagcgggtgagtgaacatgtgaaccgcattctgcggagaaatctttatgaattaaaactggacgaaaaacagaccttccggcttttaaggcagaaggaagaactccgcagatatttaaaagaagccggaaccggaaatttacaggtaaaagagtatttgatttcttttattcaggaatttctgttaaacggaatgaagatggatgaagagatgataaagcatacatttttcttttcggaaaaaggcagcaggcaggcggcggtcagatttgatattctgctgtttctgtataaagaacagtatggcagcggagcaatggaaaaactgatcgaggaacacggcttattgtcaggaacggaaaatgtgatcacggaggagcagattgagcatgtttatggagtctgcggaagaaaattgaagttcattgagcagatcgagcttttgagcaggaagatttatgcttactataaagggcttggtgcaatcgatgagctacgcgacatgaagatcgacggtgtttccggcggtgtgtccggaaaagaggggacgtatcacagtgcatggattttttatcatggaagaagtgtctggctgccgtttctggattttgagcgggaggaagagatggagcggatttccagaaatctttgcagatatcatcagccgggagaaatttcacgaaagaaaggatatctcgttcatgagatggcagatcatgccagagttgtagttgccagaccggattttgcggagaactggatgttttttatccgtaaactcgacaatatcccggaagtctcgttacagcagcttgtgacaggcggacatgcagaaatcccggtcgaacttttaaaatggctcatgaagggctgtcaggtgacggcggtcaccggaatgcagggctgtggtaagacaacattgctcactgcgatggtcggagagatcccggaggaatataccattcgtgtgttagaactggcatttgaactgcatttgagggagcgctatcaaaacagaaatattgtgacgttccgcgaaacggcggggatgatggaacacggtggaattggcggacaggaggctctggaagtacagaaaaaaacagacggagccgtgagcattatcggagaggttgtcagtgcaaaagtggcgtcatggatgatcgagagcggacagacaggttctctgtttacgatttttacgcaccatgcaaaaagtacgagaagtcttctgctgtcacttcggaacagtctgttgaaggagggcagttttcagtcggagagagttgcattagaacaggtgacggaagtggtacgttttgatgtgcacctgcacatgagcagagagggacagcgctatatcgagaggatcagcgagatcgtgcctgacacggaaagtccggagggataccggatcgtggaacttgtacggtttgacggggaacggtatgtgaagctacataccatcagcgagacgacacggtcagaaatggtgaaatggctgacgaaggaagagaaggaggcatttttcaatgtggatatttgagggcattttgtatgtcattcttctgcttgtatttatccggtatgaccgaaaaaagcggctttggataaagacggtctcacaggaggagaagttcgaacattatctgtcagagttatcggccacttacggaaaacagaaaaatattgaggaggcagtggcagaagtggaggagtcacatacggtcacacttcccacagaacattcctatgtgcgtatctatggcgcaatgtgtgcggtcatccgggaggatggagatatactttcggatggatattctgtctttcagagaaatctgcagtatctgaaagaagaaatacgcgaaaatctcctgctctgcaagtcgaaaatgcatggttttacagggcttgatgttctttccgtccttccggtctgcttcctgccggttgtgaggctctgggcgatccaggtttcagaggggctgtccgcttattattatggcagctatggaatgttgacaacagtgctcctgttcgcggcaacgattggaatttatggacttatcctatggctgtttctgccggatgaggaacaaaaagaccggtaccggctggaaaagtggctgttacagtttccatggatggcatatttactggatgtctatgtcagccggcattatacaaaatgtctgaagaaaaatgaacagatcaaacagttgcagggatttggaaatgtcagggcttttctgatgaaaaaggtctgcttttttgcagcggcattgcttggaagcgtattgtttctcacggtgtatcagaatgcagagcgttcccagatcctgacacagataaaaattccgtcttatcagcttatgatgctgccggagagggcgcaggagcaggtaaagaaacaatatcaggagctggtcgcacaagtggtgcctgaaacgtttaaaatggaccaggaggcatttaaagagcatctggagcagttagcagtctgggaggagttaaagcaggagctttctttaacagaaagtgtgcagggggcggaagaatttgtgaaggcactttttctacaggtgagggcatatcagggaattcggattgcctggtatcacattttatttattgttgtggtatcaattctggcgtttcagattccggaactttttttggtggcagaacagtggaagtctagggaaaaaaggatgagtgaatgtctgaggctgcagacggtagtacttttactcattcattatgagaagacaacggtggaagaaattttatgccagatggagaattttgcggttttatttcaaagccagatggcagaagcggtggatcatttttcttatgaccggatcagatcacttcaaaaattaaaacaggagatcccggatgaaccggtacagagaatctgtgatgcactggagttttgcgaggaactgcctgtggaggaagcgtttttaaaccttgaagacgaacgcgaatattttttgaagaagaatatggaagagcggaagaattatcagggagaatgcattgcactggcaaaaatggcagcgtatctgccgatgtttttactcattatattaaagctggtcgtgccgtttgtggcggagggattaagcgaacttcatgcatacagccagagcatgacgggatttttttaggtaaaattgttataaaaaataaatgaaattaaaatgaaaaaggaaggtatcgatcatggaaaatagtttaaaaggattaatgcttgcagcaggaattatcattacctgcattattatcagtctcggattttatattgcaagagaggcgagagatactgcctcggagggaactgggcagatcaatcagctgcaggcggagtttacggatgcgtccaaaacaatgtatgacggcacggaagtgtcaggaagcgaagtgctgaatgtcatcaggaaattcagtgatgagacaatgggaattcttgtacagacgaataaaaataaaacgtactacaattataattttgacgtggataagggggagctgggaaaagcgttagataacagctacaaaaatgcgcaggatgtggcaagtgacaagtatatcaatccgactgcacgctttcagggcagtatcgtaaaggatgtgaatggcacgatcatcgggatcgtgttcgcacaggtatagtacgcagtgtatccggagagtacaaaaagataggaggccagcaatggaagaaggattgcaggggttgttgatgggagctgtgcttgtgatgtttctgatcgcaatggagtcagccttgcaggtggtggacagcagtgaagcgttggaacagacggtggaagagcggatgatggagcagagaaccattacggtacagagaatttcagaaaaagagagtgatgtgtttggatggatgaaatatttggaagagtgactgcgattttatttgcagcagcggtgtttatggggatgccgcttttgtacatgagtgagcgggcaaaatcagcagaacagatgtatcttttgacggtcaatacagagtttgtggacagcatttgcaataccggttttttgacgatggaaatgtatcagcagttttataaagaaatatctgccgcttcaggtatttatgaggtgcatatgtatcgggagcagaaagacattgtactggagcagggagactattcctatgagagtattttctttgatgaaaaagatatgttagccgaattggagaaaaatcgtgtgtatgaatttgaacgtggggattatctgaaagtggcgatcataaagaagaagggatggatgaatttcgtgggaagcagggattcttcggtcaatgttttatatggaggcacagtacggtatgaagatttctaactggtgtatcttattttcggtacttttctgtggcatgatattgtatacagatctgcgattccgctatacgatggaggcacagtataccatggaggagtacaaccggatttttgaccgggcagcagatgatgcgctgactgatcagctgcaggaggagtactgggatggcagcctgaaaatagatgaggagaaagtacagaaccgattttttgagcagactgcctatgtgctggatctgacaggagagacagaaaaggaaaacttaaaggaacttgttcttttgcgaaaactggtaaatgagaaggggaaaagtttatccgtggaggagagcaggaaaattcagacgcagatggagaatatcacaaatcaaaggtcaaagcttactgatatggcatatctgatgctgttcccggaagcggaacatgaggaatgggcacagaatctgaaaaatcatggattttacacttttctggaaatgccggataccgagcggtatccatggacgaaaatgtttgatctcgatgagatacgttatgcgcttagtggggcagaacttgtaaaaaaggaagaggactaagcctcttcctttggttcaggttttttgatgtatattttttcaatacggtttttatccatctgttcaacacggagcagtacatcatcatctgtaataatgatctcatttttttccggaagatgatctaataagccgatcaggtaaccgccgatggtgtcataatcgtcggattcaaaatcaagatcaagcttttcacacaaatcttccagatttgtagaaccgaggacaagatattcccggtcgcttagttttacgatcggatcttcctcatcggtatcgtactcatcacggatttcacccacgatctcttctaagagatcttcgagagtgataagcccggcagtagcaccgtactcatcaaggacgatggcaagggaaatggaagatttacgcatttccataaaaagctctgcggtatttttatgctcatatgtaaaatatggttcccgcataatgtcctgaatagagaaatgttcccggtctttataaagcagcagatccttcatgttgatgataccgatgacattatcggtagtgtctttgtaaaccggaagacgtgtaaatttgtcttctttgaatatttcaatcagttcatcgtaagtgcagtcgatatttgcaaatgtcatatcaattcgaggtaccatgacctcttttgcctgggcatcaccgaaatcgaatacgttattgatcatctcatgttcttcggactcaataacgccggtttctttcccgacatcaacaatggttcgcagctcttcttcggtcatggctttgtcttttgcattcggatcaacacgcagaaggaataagaatgcaatggaaagtttatttaaaataaaaatgaccggagtgagaagtttcatcagccagtaaatgatgttgcaataggaaagagatattttttctgcattaatggctgcaattgtttttggagaaatttccccgaaaatcaaaatcaacagtgtcagaataccggttgcgattccggcaccaacacttccccacatatccagagcaagagaagttgcaatggaagatgcagaaagattgacaatattgtttccgattaagattgcacttaacattttaccggagtcatcggtaactttaagtacgcatgccgcacgggaattcccgtcttctgcgagagagcgcatacggatccggtttacggtcgtaagtgcagtctccgcagaagaaaaaaatgcggaaagtaaaagcagaatgattaaaataataatctgaaatatggaacccgagtccaaaaatattcacctcatctaataaactatgattaagaagcggaaactattcttcgatactgtagtttggcgcttcctttgtaatgtgaatgtcatgtggatgactttcacgtaatgctgcagcagagatcttgacaaactgacctttttctttcagatcttcgatcgttgggcagccgcagtagcccataccggaacggataccaccgatcatctggaaaacagtgtcctcaagtgttcccttgtaagcaacacgtccttcgacaccttctggtactaattttttagcaccttcctggaagtaacggtctttgctgccgttctccatagcggcgagagagcccataccacggtaaactttgtattttcttccctgatataattcgaaagtaccaggagcttcatcacatcctgcaaagagacttcccatcatacatacgttagcaccggcagcaagagcttttgtcatatcaccggagtatttgataccgccatcggcgataaccgggataccgtactcttttgcagcagcgtagcagtccatgatagctgtgatctgaggaacaccaataccggcaacaactcgtgtggtacagatagaaccaggtccgataccaactttcactgcgtcagctccggccttgatcaggtcacgggtagcagcaccggtggcaacgtttcctgcaatcacctgtaagtcagggtaggcagctttgattttcttgactgcctctaagatattgcgggaatgaccatgtgcagagtcaaccacgatcacatcaacgtgggcttttaccaaagcatcgacacgttccatcatatttcctgtgataccaacgccggcgccacagagaagacggccgagatcatctttggctgagagtgggtatttgatctgtttctcaatatccttaatggtgataagtccttttaaatggaagtctttgtctacgatcggaagtttttcttttctggcttttgcaagaattttctttgcttcgtctaaagtgattccttccggagctgtgataagaccttcagaggtcatgctctcactgattttttttgtgaaatctgtctcgaattttaagtcacggtttgtgataataccaactaatttgccaccctcacagatcggaacgccggagatacggaactttctcatgagatcttcagcatcctgtaaagtgtgttccggagaaaggaaaaatggatctgtgataacaccattctctgaacgttttactttgtcaacttcctctgcctgtgcctgaatggacatgttcttgtggatgataccgataccgccctgtcgagccatggcgatcgccatgcggtgctctgttacagtatccattgctgcactcatcattggaatatttaaaacgattttttttgtaaggtgtgttgttaattcgatcatattaggtgttacttctgaatactgcggaactaataatacgtcatcaaaagtaattccatcaccgataattgtacccattttttagatcctctctttcttcatcttgatgtgttattttaaaataattatatattaaggtaattgttctgtatcatagcaaaaaaaatacataatgtcaataatatataagtatagatttataaaataaataaacaaattagtaaaacttataaaacagaaaacaaaggctaataggaagaatcatgataaaggtattcacaaatgattttcggtgtgatatgatgaaaaaggcaacggggctacaaaaggggtcacgctgccttttttatgtaaattaggaaactttgttctattttatgcaaaaggtgtgtttgtcagaagaaaaacatatccttataataaggtaaaaattggagtgagaaaatggaatttcgaccatgcattgacattcataacggaaaggtaaagcagattgtcggtggcagcttaaaagatgaagggaatatggcagacgaaaattttgtttccggacaggatgcagttttttatgcaaatctttataaaaaagaaggttttcgcggaggtcatattattttattaaatgcgagagacagcgaatattacgaggcgacaaagaaacaggcggtgagtgcgttacaggcgtatccgggaggtctgcaggttggcggcggcattacggctgaaaatgcagaagaatttcttgcagcaggagcaagccatgtcattgtcacatcttatgtattctgtgatggacagatccagatggaccgattaacaaagcttcgggatacagtgggaaaagagcatctggtcttagatttaagctgcaggaaaaaagatggaaagtattatattgtgacagaccgctggcagaggttcacagagcagatgatcacagaagatctgttagagcagcttgccggttactgtgatgaatttttaatacatgcagttgatgtggagggaaaggcaagtggtattgaagaggaacttgtctgtttgttaggaaattggggaaaaattcctgtgacttatgccggaggcgttggagattttgaagatcttgccagactgaaaaaactgggcaaaaacatgttaaatgttacgattggcagtgcactggatctttttggcgggacaatgtcctatgaaaaggtaaaagaattctgccgggaatgaaaaagtaaagaaatataaatgttggaggattggattatgagcaagtacacaaagcaggatattatccggatggtagaagatgaggatgtagaatttatccgtctgcagtttacggatatgtttggcacattaaaaaatgtggcagtcacctcaagccagttagagaaggctttgaataatgaatgtatgtttgatggatcttctattgagggatttgtgagaattgaggagtctgatatgtatctgtatccggatcttgatacattctgcatttttccatggagaccacagcagggaaaggtagccagaattatctgtgatatttatacggcagacagacagcctttttccggtgatccgagatatgttttaaagaaggcggtcgctgatgcagcacagatgggataccagtttgatgtgggaccggagtgtgaatttttcctgtttgatcagaataatgagggtcagccgacaacagaaagtaatgagcgcgcagggtattttgatctgggaccggtcgatcttggggaaaatgccagacgagacatggtgcttacgctggaagatatgggatttgagattgaagcttcgcatcatgaagtggcaccggcacagcatgagattgatttccgttatgatgaggcattgaaaacagcagataacatcatgacatttaagcttgcggtaaagacaatcgcaaagaggcacggaatgtttgcaagttttatgccaaaaccaaaatatgggatcaatggctccggcatgcatgtcaatatgtcattggctaaggatggtaaaaatatttttgccgacccggagggagagatgggactcagcaaagaggcgttctggtttatcggtggaattatcaagcatatgaagggaatgacagtgatcactaatccgctggtgaattcttacaaacgacttgttcctgggtatgaagcaccaatttacattgcgtggtcagcaacgaaccgcagtccgctgatccgtattccagccgccagaggagttggtacgagagtggaacttcgctgccctgatccggcagccaatccgtatctggttttagcagcgtgcctggaagccggactcgatggaatccgcaatcagatcacaccgccggatgcagtgacagaaaatgtatttgagatgcgtctgtcacagaaggcaaagcttggaatcgaatctctgccgggtgatctcgaacaggcagtggaagaattggaaaaagatgattatatcaagaatgttttaggcgggcatatcacagaaaaatatctggaagcaaagaaagcagaatgggcagattatcgtgcgcaggtaaccgaatgggaaatcgaaaaatatctttataaaatttaagctgaagccggattagattttgaacaatattattgttgcatttcccaaacaggagacagcccaaaacctgaagaaaattttgctgcagaatggatttcatgtggatgcagtctgctctacaggttcccaggcactgcagagtgccaatgaattgggtgggggcattgtcatttgtggctaccgatttgtggatatgatgtacacagaactgcatgagtatctgccggatcaatttgaaatgctgttagttgcgtcgcctgcaaattgcggggagcgtgatctggaaaatattgtctgtctgtcgacaccgctgaaggttcacgaattactgcagactgttgaaatgatggattacacaatcacgagacgtcggaaaaagcagagggaaaaaccaaagcagcgctcaaaagatgaacaggaaatgatcgctgaggcaaaggcgcttttgatggagcgaaataatatgacagaagaggaagcacatcgctatattcaaaagcggagcatggataatggaaccgatctgacagaaacagctcagatgattctaagtttgctgctcgcataaactttttatccaatgaaacagaatacccctgacataagataaaatcttggccgggggttttgttgtctgaaaaaacgctgtgaagaaaataaggtccgtcagaaaatgatatttttgagaaaaaataattgattcctggtaaacaaaaatgcttgcaactgtaacacatcaatgctatactaaagcaaaatttaaaggaaaattgttatgctgtaaaaagaaaaaacagcgatcatgatggaggaagagattatgttcaaagtaaatgacaattatcagaagcttccgggaagctatctgttcagcacgattgcaaaaaaagtaagtgcattcagccaggcgaacccggataaaaatattatccgtctcggcattggtgacgtgacacagccaatcgcaccggcgatcatcgatgcaatgcataaggcagtagatgaaatgggagatgctgctacttttcacggatatgcaccggatcttggatatgaattcctgagaagtgcgatcgcgaaaaatgattatcaggcaagaggatgtgatatctctacggatgagatttttgtttcagacggagcaaagagtgattctggaaatattcaggaaattttttctgtggataaccgcatagcagtgtgcgatcctgtatatccggtctatgtagactccaatgttatggcaggaagaacaggcgaatatgatgcaaagacagagacatggagcaatgtcatttatatgccttgcacgatggaaaataattttgtgccggaacttccaaaggagacaccagacattatttatctctgcctgccgaacaacccgaccggaaccaccatcacaaaagacgagcttcaggtgtgggtagattatgcaaacaaaaatggagctgtgatcatttatgatgcagcatatgaagcatatatttctgaggacaatgtagcgcacacgatttatgagtgtgagggcgccaaaacatgtgcaatcgagctgaagagcttttcgaaaaacgctggatttaccggagtacgtctgggatatacggttgttccaaaagagttaaaatgcggcgatgtttccttaaatgcaatgtgggcaagacgtcatggaacgaagttcaacggagcaccatatatccagcagcgcgcaggagaggcagtttattcagaagccggaaaagcacagttaaaagaacaggttgcttattatatgaataatgcaaagaccatcaaacagggattaaaagatgccggctatactgtattcggcggtgtgaatgcaccatatatctggttaaagacaccgggtgagatgacatcctgggagttttttgattacctgttggagaatgcgaatgttgttggtactccgggttccggatttggaccaagtggtgaaggatacttcagacttactgcatttggaagttatgagaatacactggctgcgctggagcgcattaagaagatgtaaacctgagtttaacttaccgtggagcagcagattttgtggtgctttcctagagtttgaagggcagatatataagcgtcctttcacaagtcagaattttataggtttatgaaaagaaaaacggtacagacgaaatatgatgttcctgttcgccgggcattccgctgggcttctgagcaaaaattttgtgaagcagagcttcacaaaatttttagaatcccagctccatggctcacgaagaaaatcatatttgtctgtaccgtttttctttcatttacgctgtgaatgacttgtgagaggacgcttatatttgcccaatttacactgtgaattgcaccacaggatctgccatttacgttatggaactcacggttatgggatgagtgtctatattgggttcggcaggagattccattttgatgaacaattcaatgcagggagcatctcatctcaaaaaagccaatgcagatcgatgtgctggtcaaaaatgaaaaacatgtaaagctcaaaaagaatatcgggaggatcttccggtagtacaatatcatagagtacaaatcaccggaagatggcagtggaacaggaagacagcggcatatactaccccatcggggatgccatcccaatacagcttgtcatagtcccaaagctgtcaaaggagcataactactggctgaataatttaaggaatgaccttaaggcgggcagtgaaatcaaaaaaattacagagagtggtttaaagtctattgataatacagcaataactcattcatctgtagggaattttacatataatcccaagacaggtgctgtatctaaaatgaagggcggaggacatggacaagccaatattgagtttttagaagctaatggacttgaatacaatattgtaaaagtatatgataatggtgtcagagttggtgtaattcgtacaaatggacgtattagtacaatatttcccgatgctgcgtcgcaaccataaaatataagaaggcatataatgattaaggatataatggatgatataatttcagaaagaaagagtaaaaatattgaagatgattatggtattcagaactgttggaataaaatgatagatattttatctaaagatattaatgaaacagttgcatatttagaaaattgttctgaagaagatatttattttattagtgaagtttttgaagatgtgtctgaacagttgcaaagtaaagaatatattgaatgtttaaggaagttggatgataaatttcctaatttggacatgacaaaagatatcgatttggcagaagagtatatttaatcatgccgtgggcggtatagtggcagtgtttctcaggtggagatgcaaagccgattagtgtaataggtattaatggaaaggcggaggagcggtgagtatgggaaaaaagagaacgctggctattatactgttactgtgtgttctgggcgggctgatagcttgtggcagaaaagaaaaagaagatgagtatacctatacgattaaactaaacgataatgcatcgggcagtaagcagttttcctcctgtggttatttgtgggtttactctgtgacagatcagatgtttacaaagtacgggaatggtgaaatgccaagcagctggacggtgggggatacctatatatttttcacaacagagcagaaaaacggggggatggacagcagctataagttgtggcgatgtaataaggcgacgaatgagtgtgagtttttgggggatatgtcgagtgatgcgagactgaacattcatgaaaattatttattccttgcgtttgggaaagacaaggtgtggttgatgccggtggaagggaatttgggggagaggatcaatctggtagaacagttggcagaaaacgatggagattcaggaagatacgaattggatattgctggttatcatggctggaacatctattcgtatgatggagatattatagcggtgacagatcaggatgatcatagcgttgccataagtaatgttttgtcgattgatgtgcgtgtagataaacactggtattataaagatggagagagtattgagtttcgggatgactattttcaatataggagagcgggcgaagacgaatggcatgatatttgtccagagtattttggtaacatattatggtttaaacttggaattagggaggtaaattttctcccaaagcgcattgtgaaggaaggggagaagctttatctgtcagttgagataggaaggacgaaggtgcttgagatgtcacagaagcatttagagagagaagtgctggtcgaaatcgatcttgagacggacacgagccgtatgctatacgatacgcgaaataataggacaagaatcgtcggataccgggagggaaatgtttatctgctgaaagatcatattgtatacaaaaacgtgttgaaaactggagagcagagggaaatgtatgatttgggtcaagaaagcatgctctggtatgaggaagatggagaacataaggatgttcattttgaatggtatggagattatatggttgtatggagctataacaatggggatggggaaaatctggtgacgataaaaagcctggatatgacgaggtaggaaacattaggagaatggtaatctgagagagagggcaaaggataaaataaaggagatgatttgtatatgatggggatgagagctaaaaaaatctgcatggcaatgctccttattgtgggcggtataatggcagtgtttcttgcacatagaaaagtggcagagaaaatcacagaggaagagtaccaacgttttttagatggggaagtgcctgctatgaaagagaatggaaaaacttattttctggaagacttgttcggggaagatgtaagtgatgttgaaacttttttatctgatattgacggagatggagtgaaggagctgcatatccggaatggcatttattatattttaaaagaaaaaaaggggaaactgacgattctatatgagggtactgctacttacgatgagccggtagaagcgatgtccggcattctgtattatagggagggaggggcaccatataatgaggcttactattttacaagatttgaaaaagatggaacaatggtgaaaggacctacttatcaatgctacgacagtgacgaggatggagagattggggtggaagatcgttatttaaaggacggcgtagagcaggataggactgcgtgggagaaggaaacggagatatacagagcaataaaaaatgagcggggcttatagtcgggttgtttcgatggggaaaaatcaatgaagtatattcagaacagaacaaactggtgctgggtggcggcctgtaaagttgccggagaacagtataagaaaaattttacggaaatggcgtttacactggaaaatccggagacggaggtagcggtcagcaatctggatggactgcgtacagatattgtaaaaagaagaaatagaatatattttgtggatgcgaggcttaaagtatgttgtgctgggagattgtgagagtaacttgatacagacaattacattaggtacatacgaatccgtacacttaccagagaccaaagatcacgccgttaccgaatgagactggcttaaccgtgccgggaggaacgggagtggcagtggtgccaaacgggacagcgtcagccttgaagcagccataccttccagggcagtataccgaatatccggcagcggtgcagggatgggcacagcaggctttgccgggaggggggagtggtattgagggtggcttagatacatcaataaaaaatatagacgaatttattggaggaaataaatcatttgatgatgttttagatgattatgcaaaagtatatgcagataaaattaactccaaccaagcgtggtcatgggatgatgcaataccaggaggagagaatctcaccaaaaagcaaagaagtattattaaacaacaggctatagatgctggattaattactgacataaaggttaccaaagtagaaggcatgagatatggctttgccgattttgaatctgcaggagtagtaaaggaaacacaatatttgccagaaaacatgtggaaaatgagcgatgcagagcagtttaaatggctggatgaacaaattggtggaactgtagacggatatacatggcatcatacagaaataccaggtaaaatgcaattagtaccaacaggaatacataatataacaacgcacaatggaggacgaactgctggaatgtgggtagatgcccctcgataataggaggatataaaatgacgatacaagataatacgattattcaaccgataccaactgatgaattattagcagaaaaagagagaaaatggagattggttttgccagcggattacagaaattttgttgtgaattataatggtggtataccaaatgaaaaatcatttgagtgtaataaacataattatgcagttacaagatttttgtgtattttgaagaatgttcaagaaactcaaaatggttggtatgatataagcgctgtagaatcccaaataggagagcgtttgacggataatgaagatttaattggagtagaggttctgccaatagcagagttattcgcaggagattatgtatgtttagattatagaaaaagtaaagagaaaccttcaatttgtgtatggagccatgaggaatcagaagattttgctcctgtaacatacaaggtagcagatacattctcagagtttgttgaaatgttgggataaaaaaacagaaaagtgttctgtaataattttgtaatggttccacttgacgatttcaaacacccatgttacaatggcgcgcaccagggggtataagggggaaaaagatatcttttacaactaaatagaaatacagtatcggcggtattcctagacctaaacggttatgaatgccgctgatttttttgcttgcgattattagtcggttaactgcattagcaaggaaaaacagcattgcatacctattcggaaagcaacaactgtaattaatgagggagaggttccttatggaacaaaaggaagggtacgtccggattattacaaggatggattttgcgtagatataaaaaattacaacgtagaaagtgcaagtggtagaagtaatcttgcgcggaatattgaaaagcagtattatcaaagaatagaaaatttgcccgatggaacaaagcaatcagttatgattgatgttagaggtcaaaatgtttcagatgaagctttaggtgctttgtatgatgacattatgcggagaacgaataatggtgttgaaatactgtttaagatggactaggaggatagcatggcagttggatttaaggtaaaattttattggtatcaaataggacatggtgattttttatattcattcttttctacggtagcatataatttggaaaatgggaattggggaagtcgtttcccagtaattatgaacgagttatatcaagggaaactggagtgcgataatacggataaggcattagaggaattaagtataatcaaaaaagagttacaaaaattcagtcctgaaaaggtcgtttgggacatagaagatttgtcaaaacaacctccatggggaaatgatattagtaaagacattacagatttatcaaattattttgtaacaagtgatgggaatgatttcctaactgttttctctcatgcattagagaaagcaaaagaagtcaatgctgaaattgtaataaaatccatgtaagagaatgtgaaactttttctgtaaatgatgttatgaagggtcttctatgataaaataaattatcataaggaggcctttttactatggcaagagaaaagaaacctatacacagaatgcaaatgacagaaggaaaacgtaacatcattcaccagcttttagaagaatacgatatccaatcagcggaagacatccaggatgcatccaaatcttcgtatagaagtaacatctgagatattaccagatgttaaagttacaggtaaaagtaattttgtaattcaaaatggacaatatgtagaatagagggacaaatatggatataacgaaattagagcaaaaaaacaaatgtatctttgctatcaaattggcagaaaaggcatcttcatatttgcaagaaagtaatgtaaagggattaataaatgaagctatagaagttagttggaaatgggtacatacagaagaaaatgtaggagaagtattatataactttttggataatgaagaaaatggatttacattatttcaagaaatggaggaagatgaaaaaaaaataagtgcgtgggactgtattatagatgctgttgcatatgtatcaagagccgcatacgaaaacgaaggcataaaatatttacctgagaccattgaaattgtcgatgacaatattttcacacatatggtgcaaagtttaactttgtgtgacagcatggaatgtgaatatattgaaaaggtatacaaaaaatgtttggaagaagttaaataggttaatttggtaataattttgtaatatttttcttgaagatctaaaacgtccatattacaatggcactcaccagggggtataaggggaaaatgattctttttttaactaaataaaaacactgtatcagcggtatttataagactttcaaaaaccatgaaataccgctgatgttctgtccgtttttataggtcagtcagttatatcagttaaacatgattttcgataaggtctgattggatgccgtccgttctttatatctttttatcaggttgattgcaagcttccgggccatgttcaggttttgctgtatatttttgtcctctatccggcactgggcatggatgtctgatcggaaatgctattctgtatccggggtgggaggagtttccctccgtggaacagcgggagggggagttagtgtatctgaagttggacatggacggggcagacgggaaagcgctgtcatcccaaggaatcctggcaggaacggaatacgaatactataagccctttgatgatgcgccggagtatgaggagtacaaggaggtgccgacatggctgaaggtcgtggcgggagtcgcagttgcagccgtggtaggactggcagcagcggctctgggagttacagccgtgcagcttgggatgacagccggagtgctgaccgccggggcaggaattgctgcagttgcggcaacggtagccagtgacaaaaagaatgggacagagtcctctctgggggattatatcagcaatgcattttcggcgtctgcaagagtgggggcatcctgcatagccataactctggggatgtatggggcagaggtgatgacgttgaccgtgagcggaggcctggggctgatcccggtgggaggaacggttgtgaccctgccacagctcgcaggtgcattcctgcttgtggcaggaacagtcacaagccagaaccttctgttccagatgagggaagtactaatgttctgtatctcgggtaaggaaatgggagcgccgacaggaaactggctgtatgacagtgcccgggatcttacagagatggcaagtatgcagttcgcggtctatggactgatgaatccgtacacttaccagagaccaaagatcacgccgttaccgaatgagactggcttaaccgtgccgggaggaacgggggggggcagtggtgccaaacgggacagcgccagccttgaagcagccataccttccggggcagtataccgaatatccggcagcggtgcagggctgggcacagcaggctttgccgggagggggaagtggtattgagggtagtacagatactttatctacgccaagctcaaaggtattacgccaaaatttgattgaatcaggcgtagaagttcctgattatttaaacgctgcttaccacatagttgcaggaagttcacccaaagcggcagaagcaagggcaattttacaaaaatatggtatagatattaatgactcagcaaatggagtttttttgccaacagtaagaggtgtagcagaaggggcataccatccaagtttacatacgaatgcatactatgataaaattaacaaattgttaggcgaagcaacttgtaaagaagatgttcttgatattttggaatttattagtgatgaattgagtagtggatcatttatggaataggagaaaaatatgaagatatggcaattaagtttcgaattagatgattacgataatttagtacctataaaagaatttacagttgaggaaattcaatcttttgatgggagaagtcatttaaggcagtggaaacctgttcaagttaaaagaatggagcctgagaaagggcttgagctaagtgatgctccgggatttacaattccggtatttagtagaagagcatgggaatgtttagaaccactgataagtaaaaatgtagaaatattaccactagattttaatgaaaaagaatatttggggataaatgttattactgttttggatgctatagattatgaaaaatctatttataaaacgtatagagatggaaaaagaattatggcatttaaaaagtatgtttttttaccaaccgtaatagagaatgtttctatgttcaaaattttggatgaaaaaacaagatatgcatttgtttcagatgagtttaagcaaacagtggagaagaataacttattaggttttaaatttaagttggtctgggatagtgaaaacgaatactccatgtatattgacagatgaaaaagagatgttagccttttgggggagaaaagtataccgcatggagaaggtggtggattatgatgatatcgtagaaggaaaagattttcggcgtctgcaagagtgggggcatcctgcatagccataactctggggatgtatggggcagaggtgatgacgatgaccgtgagcggaggcctggggctgatcccggtgggaggaacggttgtgaccctgccacagctcgcaggtgcattccagtttgtgacagggacagttacgagccagaatcttctgtttcagatggaggaagtactaatgttctgtgcttcgggcaaggagatgggagcgccgacaggaaactggctgtatgacagcgcccgggagcttacagagatggcaagtatgcagttcgcggtctatggactgatgaatccgtacacttaccagagaccaaagatcacgccgttaccgaatgagactggcttaaccgtgccgggaggaacgggggtggcagtggtgccaaacgggacagcgccaaccttgaagcagccataccttccggggcagtattctgaatatccggcagcggtgcagggctgggcacagcaggctttaccgggaggggggagtgctattgagggtggttcagtacctgacttctatgtaggtccaaatggcaaagaattgcctagtcaatataaagactggataggcacaaatatacaaaaagaacttttagaacaagctgaaaatctgcaattacaaaatgcaataaagcagttatacagaggaaattcatttataggtgatggtggaactgcagatgtaataagatttgagcaacagacaggattgatgttaggtaaaaatggtggttctcatgttcagaaaggaatagatatggcaaaatacattgaaaataaaattttgacacaagacttaagtccttcagacagagccttggccatacaattgttagaagatttatacagtgcgctaggtaggtgatagtatatgaaatatgatgaattatataaaacttttaaagaagaaattccagaaggcagctctttttttgaggttaaagaaaaagagaatttgatagatgaaactgatgggatacacatagtgtttggtatggttatagttccatatattcttaatattgtccagaataataaaatgctcgaaataaataaagtatttttatttttagagaatatggcaatatgtgaagatataaaaattaaagaagttttagatttcacagtattagagcaattagtagatgaaggacaggatattcttgagcaatgtaagcaatatatgaaaaaaaacacgttgaaacattgtgaagaagtagaaaaatattatttgtaataatttggtaacatctcacttgacgattcttaaccctcatactaatgttctgtacctcaggcaaggaaatgggagcgccgacaggaaacgggatgcatgacagcgcccgggagcttaccgagatggcaagtacgcagttcgcattctatggactgatgaatccatatacttaccagagaccaaagatcacgctgttaccgaatgagactggcttaaccgtgccgggtggaacgagggtggcagtggtgccaaacgggacagcgccagccttgaatccgccataccttccggggcagtataccgaatatccggcagcagtgcagggatgggcacagcaggctttgccgggagggggaagtggtattgagagtggtaattcttcaattcattacggagaattagattcattaggaagggcaactggagttgatgcaacaataactgttgatatggtaggaacaggcacaccagcaaaatcttcaattaagccagctggttttgggggacaaaaagcaggacatgcaagaggacatttgttgggaaatcagttaggaggagcaggtgatgacccaagaaatttaacaacattatttcaaaatccagttaatcatccagttatgagttcagtggaaggctctgtaagaaaagcagttgaagcaggcgaagtagtacaatactcagttaaacccatctatgaggggaatactttgattccatctggtgtaaccataaaagcagaaggagataaaggattttatatttatcaaacaatattaaatagaaagtaggatttataatgttagagaaattagaaaaaattctatcaattgaaaaaaaagaacaccaatatgattgggaaaaagttgaagactcatatgaaattaaatttccaaatgattacaaatcttttattgagtattatggtgagggtggaataaatgagtttttatggattttatcaccattttccgaatatgaaaatttgaatacaatttttaaatttaatgagatgagggaagcatatgaaataatgaagattgattttcctaaaatgtgtgaatttgaattttggagaaatggtaaaggtatttttccatggggaatcacagataatggtgatgaattattttggaattataaagatgattctgttgagattgtcattttctcgtctagatattctgagaaacagattttttcatgtagtatgtcggaatttcttgtagacttacttgaaaagaaaaaggaatgtagtattttccccaatgattttatcagacaagaaaattattatgaattataattctttaaagcacaaaaacagaggtttgcaatatagcctctgtttttatgtaagatttttctttgaatagtacacacaattttctgttggaatgtaataaaatttttaaggcggtatttttgatataaaaattggtcaaaaaagcggtaatttattgcctgattttcttcaaagaagcggtatagttcgaatatgaaaaagacattattagcttagtttcttagacaattcctaatattttcacgtaatcaagtttcacttcaagatgaattatgacattcgtaagacaggttactgacaattgccatggaaaaaattcttgattttcagacacgggaaataccgggggagcatgccagaggaaattttcggcttctgctgtcagaaaatgagacaggcataaacggtctgaatgcgcccattcagctttgtggacatggaaataccgcaggagcgttgttctgcggatatcaggaaaaggtggaaatcaaagaagaaggcagatacaggattgcagatgtacaggctgtatctggaacaattctgttagaccagaaaaaatgcaaccgggtatttcagaaaaaagcacagacatatatggggattgccaataccgtaacagcagacaccgagcacagcgcctgtatattgccgggcagtgatatgcagacagggggaacgttgatacagtatcaggaaacggactggaacttcctgaaaagaatggcatcccagcttggacttccgttagtgccagacatcagctattattatccccgtttttaccttggtctgccggaaggggagaaaaaggaactgggagaaatcctgtcctgcgatatgtgcttcgatgggcgttattatgcggtcagcgggagatgtaccgttgatagaaaggatttcatctgctatgatgtggtcacggggacaaggctgtcgttaggtgacagggtcacatacgaaggcagggagctgacggtttcccggaaaaaaacagaactggtacgaggggaggttctgtttacctaccgccttgcgggagagagctacacacgggttgcaccggaagagaacccggattacacggggatgtcgttcgtgggggaagtgacggcagcatgcggggaacgcgtggagctggcatttgacatggacagggcatcggcagggggaaacagctacggctttgcccctgcaacgggaaacctgatgtactgcatgccgcaggtggggacaaaggcggcgctgtatctgggaagcgggaacgaggcgcagggcgtggtgtcaggctgcatccggacgaacggcgcttcgtgcgagggaacaggcagcccggaaaagaaaggcttctgctcggagcacggcaagggaatgagcctgtatccccagagcatgggaatggacggcggggaagcaggaaagcttacgatggaggacgggagcggaacgcttctgggaagcagcgggagtctgctcctgctggcaaaagagggaatccgcctggagagcatgacgggaatcgccgtgcatggagtgtcggacatcatggcactctgcggggcaggaacatcgagcctctgtgtgaacggcagtgtggacatgatgggcgctcttacgggactgggaggcagtacatacagaaactatgcgccgtatgcagacgccccggaggaggggaaatttgactggggaggttttacgagaaaccttgtcatgggacttgcagtcggtgcggcgtgcatcgcaatgagccttctgcttccgggaatcggaaccatagcagcgggagcgctgatgggagcagggatcggtgcagtttccgcaagtgtggcaggagcggttggcgattacagcagcgggaatgtgcggagtgcagaggaagccataagagatgtggcgattgcagccatcagcggtgcaatcacgggagccatcggggtgaaatttccggggatgaaccgtctggtggaaggcggtgtggatactacagtggcaactgtggagcgcgccgcatatgcggcactggacggggacatgacgctggaagaaaagcttgcgtatatctttgatccggggcagatggctgtggattttgtgacaggtgttttcataggcgaggcggttgacgggattgcgaaaaaactgccgggtggatggaagaatagaggagggagtgaactcaataatcttgatgcccagggtatcagttcaaagtcggcaaaaggcagtgacacatttaagcaaaatggtaatttaccgaatggcgtaagaactgagatttccggttccgatttacggcatagcaatggatttgagggatttgatgttataaatgctagttcaaagcaaaaaggaaattttggcgaatttaaggcggatgataatttggttaataatcaggggcttaaagatgcaggatatgatttgaaatctgtagggagaaatgcaccttcatgtccagatgacaaaatagtaaagggtattgatggattgtatgaaaatttaaatcagaattcaaatgttgagtatatcattgatgaggcgaagtgtggtaaggcgcaactaggaaagacagatgatgggaaacagatgtcagatgattggctgctaggaagtgttactggaaacaataggattttagacgctgtagacggagatgaggaattagcatataaaattatggaggcattgaaaaaggggcaggtagaaagggtgctaagtaaagtagatgcggatgggaatgtagttacatatcgattagattcgcagggaaatatcatcggaatctggccatagaaattagtgtaatagtaggtaattgcgaaacaagttcgcaatcttgattgaaaacaaggatagaatcctgcaatgcaggattcttggaatggaaggtggcagtcattcatttagggcatgacaaaaaggcttcatagttagtatgaagcagaaaaatttataaaatctcaattttaagcaatcaaaggcttaagacttcgaatgtattgatgttgatgaattttatcagcaacaattactgtaacaagttgagctatgccagccaaaagtaaatcggcatgaagcgttttttcgttctgggttttacgattagctacgcaaaagctgtctttaaagtggttgatagatttttcaacgtttacacggattttatatgtttcttcccattctgctgaacctcgttccactccgggataggcacgaagattcttttctggataaatgtaaatcattcttccacaggaagatgttgtgcagggattatcacaatggcatacacggcgtttggttttatctgctttattgtcttcccatttcattttcgggcagacaaatttcattgtaggaattttgctttttaagtgtgatttactaccttctcttttcataggaagcgaagaatcatgcggacaacagggaacaccattttcgttaatggtataaccattatcttccatagaaagttttacacggagaggaataaatgctttttcaaatccaatttcatcgaaaagggctttgtagatttcaattgtgtcaaaagcagcatcaccaagaaaagtcttaggggcgataagcggatgcttctgaaagaaatcaatcagaacaggaagcagggcctttgaatcggcaagagatttatcctcatcaggagagtcagatttcttttccacaacgatatccggatgagcctttaggaactctttgttatagaaagtgatatcacggacaatgccaagcccattggttacaatgccgaacttataggcatagcagaaatgtccattgatatacatctgttggattgcctgattcgaagcagcatgcgtaggcatggaaccataagcagccttataaggatcatagcttttatcaaggttgtttgcctttgcaaaagcttttaactgtttgataatacggtttgcgtattttggattattttcagttacccaggcttcaatgccagaggtatcgaagatagtcatagttgccagatgagggtcaagtttttggcagatcggttcggtcatatcaaccatgtgattgaacatagattgtaagtccatcaggaaatcctgtttaaaacgggtaaattttgaggcatccggtacaacatcaaagccacagaagtcacgcagttcctgagagtatttcaagaacacaatcagaagtgtgtcagtcgggattgagaaaatacgctggagcagaagtgctttgagcattggataaagctggtgcttgcgaggtcttccggttgaagcgtgaaaatgagaaacaaaagaaacaggaacaatttcatcaaggttaatggtttcatcaagaagtgaaaggaactggtatttgtcattgtcgaatttattttggcaatcatcaaaaatttctgccaaagtgagctgcttatgtgttatcatgtaggtatatctcctttaggtggattggttgatagtttctcgcaactctattttaccataaaccttgaggagatattttattttaacaacaaaaaaatgccgtatttatgcggcttgtggcgtttcgcaaacgcctatagtgtaatagaaagagaaggagacgtcaaatgagagacactttatgtaatgaggactatttaaaaaagaaaattatacttaatgaaaattatattagaaaaaatattgaggaaattgttgtattacaagaggatattaaaaatggaatacagcgctatccaagggaaaatagtgaaattatttatgatacgaaattgatgctgtttcagatgatttatagttcgatttgtgcaaaatattcattgggtttatcatgtgacagctttgaagaaatgtatttgcttggtgtaaaaatgatttcagatatcggctatagaaggattggctatgttcatatgattcagtttttttctataggaatgttgcttgaaatatcagcgaaagagatgcagaagctgatagaaaaagcagacgaagaagaacaggatgatattttgtttgattttcttgtaaatgcatgcggatgggagaggaatataaattcctcacagtttcaaaaagaaagcccgtatagtaaaacactggaaattataaaattggcagcagaaaaccgggaggcggccaatattagattaaagaaatatgtggaaaaagagtggctagagggacatgctagttatgggtggaagaccgcacataaaaaagttggatatgtgggattatggagttttgagtcagctgcattagcaaagattttggcattaaatgacgagaagttaaagagcaatagtcattatccatatgatttggctcattataaatcgaacaagagattttctgtaaaagcgatagagacagtggaggagaataggcgtaaagatgagactggtgaagggattgtatcaaatcgggaattggaatgtattgttcctgcacaattccagaatatggtaaatacagccattatggattatgacaaattagaagatgaagagttttggaacaaatataagttgagtgaaatttggtatacattagagatgtatgaggatgataagaaaaaagcaatacttttaggaacaattcttgttaacttattggtagataaaggatacattatacaaattgactataaagaagatattgaggattatatagataatataaaaaatttttggggggaacaggagattaagttggtccggtttgagttggagaatgaccaaaattattatgcaaaggttcctaggatatcaaatgtcaagaatatgtacgaagtacatattcttgacgagagataattggtgataagacaatatttgaaaaatgaagtatataatacatgctttgcgcagctggagctggagaaaggcgaggagatccagtttccgtacctagtgcggggagcagagctgtactgcagctgcggaacacataaaaggaaactgaatctgccaacatgccatggggtgtatacaaacgggaagcctatgatgcacgaagaagattgtgaggttggggatgacaaaaatattccatcttttggaatttgccaaagcgaagagaatccggtgaacaaatcatggtttgccaaagcaggggacaagatcaaggatttttttaccggagaggaggacacggatgatgcggaaaagatcatcctaaagacggaggacggacagaacgtgaaaggctatccctgcacgccctgcattgtgggaacatggaaggatgtatatgagtcagagaaaattcttagaaataacgcagatgcaacaagtgaaggagataagctgtctgcattgacacagagatcatttcttgtttgtgcctatggaggattaatagaacccatatcatcaggtcaggaagaataggagaggtttatggcagaaggattacaaaggagaattgaatattccgatttaaaatttatcagttcctttgccatggaaaagatccttgattttcagacatgggaggtgccaggggaacatgccagaggaaacttttgacttctgttgtcagaaaatgagacaggcataaacagcatggatgcacccatacagcttttggggcaggggaatactgcgggagcgttgttcagcggatatccggaaaaggtggaaatcaaagaagaaagaggatacaggattgcagacatacaggctgtgtcaggaacaattcttttagatcagaaaaaaagtaaccgggtatttcagaaaaaagtacagactcatatggggattgccagtgccgtaacagcagataccgatcacagcgcctgcatactgccggggagcgacatgcggaccggagggacgctgatacagtatcaggaaacagactggagatttctgaaaagaatggcgtcccagcttgggcttccattagtgccggataccagctattattatccccgcttttaccttggattgccggaaggtgaaaaaagggaattgggagaaatcatttcctgtgatctctgttttgatgggagatattatgcagtcagtggaaaatgccttgttgatagggaagatttcatttgttatgatgttgttacgaggacaagcctgtcgttaggtgacagggtaacctatgaaggcagggaactgcatgtttctcagaaaaaaacagaactggcaggaggggaggtcatctttacataccgccttgcgggaaacagttatacgtgggttccatgggaggataacccggactatacgggaatgtcatttgtcggatccattgtcggaacgcagggggagcaggtagaagtagcatttgatattgataaaagtgcggcaggtggaaaccgttatggatttgctccggcgacaggaaacctgatgtactgtatgccgcagaagggaacaaaaacagcattatatataggaaatggagatgaggcgcagggaatagcgacagggtgtatccgtactaatggaagcacctgtgaggggactaccatagaaagcaatggcgggcttgttctgatggcaaaagaaggaatccggctggagagcatgacagggattgccatgcagggaatgtcggatatcatggcattgtatgcagaaggggcatccagtctttgtgtgaacggcagtgtggatatgctgggcaggctggcaggaatatcagccagtaagtatacggggtatccgccctatgatgatgcacctaaggagggtgaatttgactgggaaggatttacgagaaaccttgcaaccggtcttggagtagttgcagtatgtgccattggtgccgcaattagtatagcaacgcttggtgctggaagtattttagccggggcgtttataggtgcgggtattggtgcattatctacgacagcgatgaaagcaggagaggagatttcaaccggaaatgtccgaagtgcgaaagaagcttttcgggatgtaggaatatcggctgtcagtggttttataacgggggcatttggagcaaaatttccgggagcacatcgtttgactgaaggtgttgtagatacggcggtatcagcaggtgaaagacttgcgtatgcagtctttgatgacagtatgtcatgggatgagaagtgggcatatgcttttgatccaggacagatggtggcagattttgtaacaggtgttgtcataggagaaatccttgatgggataatggcagcaacacagaataagttaagaagtatttttgcaaatagtgatgagatgcggtgggcacttgatagcggtaataagacgaaaccatatgctaatagcagaccgtcgtttagaaaaggtgttgtagaggaagtatgggagaatgcgaaaggtcctgatggattggttagagatcctaatacaggtgatataattaattggactccaggtcaatcaagaaaaggagtttgggacatgggacatattccagaggcaaaatattcagaaatgcatgaagcatatatgaatggagaattaacaaccaaagaatttgtagactggtataatgaccctgcaaactatagaccagaattaccgagtaataatcgtagtcataaatatgaataaaggagaaatcaatggatataagtttagtagctaaaatgaaaaaatatgatgagtttatttcttgttataacgaaggagatgagaaaaaattatataaaggaaaatcattattattttattcattatctaataatgatgcagaaagccgttatttaataacagattttttacttaataaaggtgctgaaactaatgtgataaatgaatgtggcgaaaatttattacatattctgttgtcaaggacaaatcacaatataaaacaaactgcagagttgtgccaaagattaattaaaaatggagtagatattaatcaattagataaaaaggatagattgccattacaatatgtggttaatatgaaatatactgatgaggaactcgagccattatatcaaatttggttttcacaaaataatgttttagttaatcacaagaatgcgtggggaaaaacaccattggaaattgcggagaaaatgccttatagagcaagtttactagaaaggatgaaaaagtatgagtgaattagtaacttttatttctaatgctggtggaagtattgtttcaaaaaatatattatcccataagggaaagttgagatggtgtgttagagaagaagctataaatgatgtagataatggatggaggttttttgcagatattgatacagaagaatatttgagtaaagctgataatatgtgtatatgtgattttaatactgtagcaaatatagaaccagcaattttggcaatatatgattgcaaagttggaactgatatagaattgatagaggagaatggaaagaaagtttttttagatagtaatacgggagaaagaattaaatcatagtatttacttttgaataactattaataaattcaaaattatatatatgtctattggagcggcttatggcagaaggattacaaaggagaattgaatattccgatttaaaatttatcagttcctttgccatggaaaagatccttgattttcagacatgggaggagccaggggaacatgccagaggaaactttcgacttctgttgtcagaaaatgagacaggcataaacagcatggatgcacccatacagcttttggggcaggggaatactgcgggagcgttgttcagcggatatccggaaaaggtggaaatcaaagaagaaagaggatacaggattgcagacatacaggctgtgtcaggaacaattcttttagatcagaaaaaaagtaaccgggtatttcagaaaaaagtacagacttatatggggattgccagtgccgtaacagcagataccgatcacagcgcctgcatactgccggggagcgacatgcggaccggagggacgctgatacagtatcaggaaacagactggagatttctgaaaagaatggcgtcccagcttgggcttccattagtgccggataccagctattattatccccgcttttaccttggattgccggaaggtgaaaaaagggaattgggagaaatcatttcctgtgatctctgttttgatgggagatattatgcagtcagtggaaaatgccttgttgatagggaagatttcatttgttatgatgttgttacgaggacaagcctgtcgttaggtgacagggtaacctatgaaggcagggaactgcatgtttctcagaaaaaaacagaactggcaggaggggaggtcatctttacataccgccttgcgggaaacagttatggatttgctccggtgacagggtgtatccgtaccaatggaagcacctgtgaggggactaccatagaaagcaatggcgggcttgttctgatggcaaaagaaggaatccggctggagagcatgacagggattgccatgcagggaatgtcggatatcatggcattgtatgcaggaggggtatccagtctttgtgtgaacggcagtgtggatatgctgggcagacatgaataatagagagacatttcaactattttcttcaggagataattaggaaatgatatgtgaaaaatgtaaaggaaaaatgaattggagtatcgaaggtgctactcaaggatggagatgccctatgtgtgggtggaatataataacaacatacattgaagatatagatagagatgaaacggaatacagtctgtatataaaaaatgtaacagaagttgatgcagaaaaaataaaatttgttgcaaaaacagctaatgttaattttgttattgcgaagcaaatgcttgaaaaaagagaagcatgtatattaaaagctaaggcacctaagattaaaccagtaattacaaaattacaagaattggggattgattttaatgtaaatccttcattcaattattgagaatgtcttaaagataatttgcagattgtaactgattagtaaaagccagcaaggataatcataacgattttctgctggcttttatgtcatgtggttttaccatttccaatctgctaattccaaaagcagtgcaaagcaacactgcatcgccatacggaaaacaactgcggtataataaatgttctacaaagacctgcgagacaatcttagatgtggtagctggtgataaagtgaaaaataatgcttaccaagatgcaagggatatggctaccaagcagggaagcagacgactgcaggcaacaatttattttcttgcaatccagatggtgcagctatcctcaaaaggcacaccaagaaatccagtagtgcgagcctactgcgagaagcgtaaggcagagggaaaaaccagccagcaggcactgatttgtatttctagacgattaatcagtatcatttatggagtgttaaagaacagtacggagtatcgcatgccggtagtggaaaatgctggcgaaaagttgtagagcaaatggcagatatatggtaaacttttaagcagatgtaacagtcggctttgggaagtgtattcatttttcggggtaggagcatcggcttggataattataagagtaaagagtctttgtcaagaccagctatggggagtcaagcggaaatatttctgaattgttagaaaatcgtccagagttgactggaacgaatcgagagaaattattatctatggtacaagacacaaaattagcagcgtatattaatgaagtgtatagaccaggtgcatctgttggagatggtggaactgctgataaattaatcatggagttttatgaaggaagttcccgtcatttgccaaaagctaaagaaagattagtcggtataaatagaataatagattcaggaaaacttggactgaatgatttagatatagctgaagcattaagagatgatttagaatacgctatagacttattcaaataaaggagattaataaaaattatgattatagatgattttttgaaacaaatgacaatttattttccaacaataaaaaaagatttggatgaacacatacaagaatttggagaaagattggatactattgttatagaggatattattatgccagaaattattgaacttttggaaaaagacgcggatacgaagaagctaaaagttatatttgactattttgaggatgtatgtattaattcagatgattatctcaataatgttttttctataacagcattggaaatattgggtaatgataaaaatatattggaaaaagctaagaaatatatgggacctataacaataaaacttcagagggaagctgatattgctataggacgacaagtataagcacaacaactaagcctccccacgggcaggcttaaatcctagtctcactaccagacatttaacagaacttcttaggttcataaggtttactatcccgtaacacggcataaattacggtggtaagctttcttgccacggctcctgtggcagttaagtgatgtttaccttggtcacgtttctttttgtaatatgcattcaacgggctattgtgaaaagagcaggtggtagccgcaagaaaaatggcatgtcttaagtaaggtgaaccacgttttgacatatggttatgtgtgctgttaaattcacccgactgacgtacagttggatcaatacctgcaaaggcaactaaggctgatgaactcttaaatctatgtatatcaccaatttcggcaagaatggttgcagtagcaatcatgccaatccccggaatagtatgaagataacaatcaaactgctcgtagtatttcatgatttcaatatcaagagcttcaatctgcttatcaagaaaattcattctgtcaatgagctgttttaactggaaagagaaagcatcctgtgctatcttaataccaaaggtatcagctgcagcttctttgatggaaatggctttagctttggtaagtcggttgtggctcttatcttttatgatttcaaagagctcatctattggtgcattctcaatattctcaggggtgagatacttttccagaatgcccatggatgtgctcatccaaagagaagaaaactgtttttcgtactctgggaagatttgttccataattgtgccgattcggagcttaatttcagttctggaagaaatgacagaatcacgataacgacataactgacgcatggcaaggatgttttcatcagccatggaagtagtcccaaactgaccgaaacgtatcacttctgcaataaaaaaagagtcaattgaatcgtttttggtttgtcgtatatacatttttcttaaagaatcagactggataggattgattacacagatggtatatccttttgcttttagaaatgaataaatgggataccagtaatgacctgtagcttccatgccaaatacacaaggggaattaccgatgtttttgaagataaagctcataagagaatctgcacctttgtgtgtagttgcaaagcgaagagaacggccgatttgtttgccttcaggtgaaacaatggatgcttcatgatgatttttgccaatatcaatgcctacgatgtacataattgaaatcctttctaatgtgaattgtaagtagatagaatcctcacttcaatgcgggttacaatctggttagatatacgaagtacagcacaaatgctgtcaacatccagctaatacgcaaaatcctgcaaagcagagggagcagtctcaatgaacgaagtcacaagtgcttcaagagtggtgacgcacacctctatctattacaggataattgtggtataggaatgaaataaaagcaatagatagaaaaagactgctttgattcctatgtgtttagcataccagagtggtgaagaaacaaaattattcttaccagatgagtattatcaaaaattagatgataatatagcaagggctatcgaagcaagagatgcagaggtttccaggattaaagggcttagtaaaactcagcaaagtaatgttgctactgttgtagctggtgtggacattcgaacaggagaagtgtatgtaggggtaaaaaatactagagtttacaaaggtaatgctacatgtgcagaggatattgtatttagaggtttaggtggaaacacaaatgctaatatcattatgactcctgctattagaccaggaaaaaatgaggttataccagtttgtactagatgtcaaacaaagtatcctagaaatcaatttgtgaaaggaacaacatttcaatgagtgaaaaatataaggaatactgtatgaagttcagtaatgaagaaataagagcgtatatggtagattatttgattagtaattcgatgaataataaattgattaaatatttgtcagaagatggcgatgaaattcaatttaatacatcggaaaaaataggaactatagtatttgatggagatgacgaaaatttatttattaatttttatggcattcatacatcaatttttgtggatgatacagaaataatgtttattgatgaaaattccaaaggaacatatacttctagtgatgtttataataatgttgtatatgaaggtaatttgcgagatatgagccatgaagaaatgttaaagatgttttctgatattattttatgtttttatgatgcagaagatatatcaatatttcaattggatgttccagagaatgcatataaaaaatataactattatgaacctcatagatttattattgaggtgaaaaacagcaatgaaatacagaaagaaagtatatatgagaatataactatcaaacattgactaatacagaagtagaagaggggataatagagaactatccaatgactgtcgaaaactaatctcaaaaggcggtatttcagatataaaacaggtcaaaaaagcggtaatgttaaagaatggtacagagtaccgaatgccagtagtggaaaatgctggcgaaaatagggagtgaaaatggcaaatatatggtagaatttcaagcagatgcaagagtcggctttgggaagtgtattcatttttcggggtaggaacatcggcttggataattataagagtaaagagtctttgtcaagaccagctatgggaagtcaagcgaaaaattaaactgggacgcaattgttagtaagaaaggtgaaaccagggttgagcatattaagcgacatacggttcaaaataatagtcgagaaacacatagtgtatttaacgggaatccgatagatatggtaaatgatgcatgggaacaacgtcatttggttgaaccgatatcggatggaatgggaggaacaatttataacattccgtacaaaaatgcaggctatgaaagtggatatattaatactggtgctcaaatggattatataacaatagtaacgctggatgaaagtactgatttaataaccgcatttccgtcttttggagattatcataagtgataggaggaacctaaaatgtataatattggttactgtaagatatgtaagcaaggcttacttgaaattgtaaaagataaattaactaaaaaaatatttatatgttgtgatgaatgcgaagcagagtggaataatccagaggatgcattaaaaggtatcaatggaacaagaaataaacatggagaaatagaatatccaactatagaagatatactaagagaaaaatggagtgtttcaataaatgagcatcacaactaagcctcccaaccggcaggcttaaatcctagtcttactaccagacattaacaaaaacttttaggctcataaggcttaccatttcgcaatacagcatagattacggtggtaagctttcttgctactgcgccagtggcagtcagatggtgtttgccctgttcacgcttctttttgtaataggcatttaaaggactgttgtgaaaagaacaggtggttgcagcaaggaagattgcatgtctcaggtaaggggaacctcgtttcgacatgtggttatgtatgctgttaaattcgccggattgccttacggttggatcaataccggcaaaggtaactaaggcagatgaatttttaaacctgtgtatatctccaatttcagctaaaatggttgcagcagcaatcatgccgattcccggaattgtatggaggtaacaatcaaacttctcatagtaactgagaatttcatggtcaagagcttccagctgttcattaaggaaattcaatctgtcaatcagctgttttaactggaaagcgaacgcatcttgtgctattttaataccaaaggtatcagccgcagcatctttgatagaaacagctttttttatggtaagtttgttgtggctcttatcttttataatttcaaagagctcatctatgggggcgttctgaatgttctcaggggtgaggtacttttcaagaatgcccatggatgtgccgagccatagagaggaaaactgtttttcgtattccgggaaaatctgttccataatcgtactgatgcgaagcttgatttctgttctggaggaaacaacagaatcccggtaacggcataactgccgcatggcaagtatgttttcatctgccatggaagtagcctcaaactgcccaaagcgtattacttctgcaatcagaaaagaatcgatggaatcattttttgtttgtcggatatacatttttctgagagaatcggactggataggattgatcacatagatggtatatcctttgaatttgagaaatgaataaattggataccagtaatgaccggtggcttccatgccaaagacacaaggggaatcaccgatgtttttgaatataaagcttataagagaatctgcacctttgtgtgtagttgcaaagcggagagaatgtccgatttgcctgcctttcggagaaacaatggaagcttcatgatgatttttgccaatatcaatgcctatgatgtacataatgaaattcctttcttttgtttagtgtaagtagatagaatcctcacttcaatgcgggttacaatctggttcgagatacgaagtacagtgaatatactgccaacatccagctaatacgcaaaatcctgcaaagcagagggagcagtctcaggttacgaggtcacaagtgccttaagagtggtgacgcacacctctatctattacaggataattgtggtataggaaggttaatatggttagtaatttattagatgaatatgtattaaatgtattgaaaaatagtggatggagtgatgggagaaaacaagacataactcaatggattcaaattttgacagaagaaggatatattgttaatgaatatgcaaaatcaattttatctgaattaggggatttacaagttagagtttctagtgataaaaatcacttaggggtaacaatgcattttaatcccataaatgccgcaagtggtgaatatgatagaatggaaatatttaatcaagcaagcaatgaagagttatttccaataggtgaatgttatgactgggttatttatgtaagtgatagcaaaaaagtatatcttggtgattggatgagcttgtcgattgcgggagatacaatagaagattttttgaacaatatattcaatcctcaatttcagttaaaagagatatacacaaataaaaattaggagtgtaatgataaaatgatattagaaccagctgtgtattgataacgtcagctggctcttgcttaccaggggaacccattgtagatattcatgattttgattagaaggagcgaataataatatggatactgtaggaataaaagtgatatcccggaatgaaattaatcgttgtataaagatcctgagaaaatattgcaaactttcaattggtgaaataaaagaggcaattattagcaataattatgttgttgaatgcagttatgtaaaagaggaggggattgtaaatattattaagttatacaaggaattatgtgataataacattcaagctcaattgtatgaacatgaacgaataacaaatgttgagtttcttgaaaatttggttgaaacatattatgaaataaatgaagaaatcgctgacagaatctggattaaggagtaaaggaattgatatgagagataaaataaaagatatagaatattttaacacatttataaatgaagatttggcaagagtaaaaaaattttctgataaactagaaaatggagaggtaaaagaagatagaatacttcctgtgaaatcaaaagtacatgacttaaaacttggaataatgattgctggatattctaaaggcgatgagttaactttattggaagaagagtatttagacttgttagcagaatgggaggaagtttgggaaccagaatattataataaaaatttaaagatgatttctttgggtattttatttcaggtagatagagcatttgtaaaaaaagtaaaaaatatgttgaaaaaatcaaacataaatgattggctatataattttttgttagattcactagatggtgaacaaatagaggtgagcaaagaaatgctttttcctaatacctttactaccttgcagagggtagtatatgaagaaaataaaatagaactattgaagaaatatttgaataatgattggtataatgaagattgtggttgctatgaagcacacaaaagcaagcagaatatatactatggatattggagttttgaggcaggcgcaattgcaaaaattttgaaaataaatgatacacaattgcgtgatacgcaatattatccatatgacatggttcattataaagaatagtatttttgtctgtgcctatggagaactgatagaacctatttcgtcaggtcaggaacaattcttttagatcagaaaaaaagtaaccgggtatttcagaagatttcatttgttatgatgttgttacgaggacaagcctgtcgctgggggacagggtaacatgtgaaggaagggagctgcttgtttctcggaaaaaacagaactggcagaaggggcatccagtctttgtgcgaacggcagtgtggatatgctgggcaggtatgaataatttgagattgccagacatgaataatagagagacatttcaactattttctccagaaggtaattaggaaatgatatgtgaaaaatgtaaaggaaaaatgaattggagtatcgaaggtgctactcaaggatggagatgccctatgtgtgggtggaatataataacaacatacattgaagatatagatagagatgaaacggaatacagtctgtatataaaaaatgtaacagaagttgatgcagaaaaaataaaatttgttgcaaaaacagctaatgttaattttgttattgcgaggcaaatgcttgaaaaaagagaagcatgtatattaaaagctaaggcacctaagattaaaccagtaattacaaaattacaagaattggggattgattttaatgtaaatccttcattcaattattgagaatgtcttaaagataatttgcagattgtaactaattagtaattagtaaaagccagcaaggataatcataacgattttctgcgggcgagattttacaatccggtgctgggaaggtttgtgcaggagaatgggtaccgcggggacgggctgaatctgtatgcgtactgtaagaataatccggtggtgtactatgatccgagtgggtacaaggataaacgtcagaccccatgcaaggaagaaacaagtgtgggggaaagtggtgctggagagagtggtagaacaactataccatcgcaacaacagatgcaagaactggtaattattattatggaatgaacagaggtgtacagttgagtggagatacgcttaatttatcgctagaatcatggttgccagaaagttctttgaatcaatatcgattaggtaattgtgctgaagtggatgctgtaaatcaagcattgaattcgggagcaaatgcttctgatttatatttgtatactattaatactaaaaacaatgtatcaaaaccggtgtgcgaaaattgtatatatatatttggtgatagagttgcagatgtgttttctcattaattggaaggaagaggtaaatggaagaattaaaaaatatatcaattagaggcagaatggcatatttaataagctcatttgaaaacgtattgttgcattataactgcaataaagaagaatggaggtggctgttagaaaaattatggtcatatacgaagattcaatacattgatgattggatgtacgaacttgcggaatatatgcctaatagtatattagaagatactatggaggatgcggaatatattacagaagaagaattcaaatatctgcatagattgtatagcaactctaatcaagaaatacatttgtttttaaaaataatattcgaatgtggaacatgtgaactatattctaaattatgtgattatagtatcaatacattaaaaaaaatagagcaagcagttgatattatgaaaaaaaataatgttgatttagttgatattaagccttttgagaaatattcgtttaatgagtgtagtggatggggaaattgtttcgagaataacaaattatcaaaatttatttaattatgtctccacataaggacgcccattaccgaaaaccttattgacaaggggtatctggttaaggacgtaaatactgctatttctcatcgtcaggcaaagcaccgtggtgccatgtatcgcaagagcgatagcgacgatgcagaagctattgcacttgcaactctaaatatgcttgataaacttccggatgcctgccctaatgatgcatactggtcacttggtcagctggtgcatcgcagggataacatcatgaagcagagaaccagactggttaatcagttgcacgagcagctgtgtattgcatatccgtcttacaagtcattttttaatgacatcagcagacctactgcactgtatttctgggagcattacccatccaaaaagtatctaaaaggtaagtctgtggaagatttgcgagcggaacttgttcctgtcagccacaataaatgctccaccaagacctgcgagaaaatcttggatgcggtagccagtgataaggtgaaaaacaatgcttatcaagatgcaagggatatggtgactcttagcatagtcagtgatttacagcactatgacagccgcccaccgaaagccatgcgcataaatgtgcttagcatagtcagtgatttacagcactatgacagccaactgacagaggtagacaagatgctggaacagatgtataagatgcttggctgcacacttacaaccattcccggtgtaaatgtcatcacagcagtgaagattcttgctgaaatcggtgatatcaaacgtttcgctaatgctaataaactggcacagttcgccgggattgcaccacttcatttatcctccagtggtaaggggaaggatgtagctaccaagcagggaaacagacgactgtaggccaattaatcagtatcatttatggaatgttaaagaacggtacggagtaccgcatgccggtagtggaaaatgctggcggaaagttgtagagcaaatgtcaaatcaagcaatgggattattagaaacaccagatggttatgtgtggcatcatttggatgattataatgttgaaaaaaatacaattacaatggaattagtaatggatgaagcacataatgcatcgaaaccacattcgggaggttgtgcacagtatgatagtgttaacggaccgacatataacaagaaaaggagatagatgtacggatttgtaaaagaaaaaagtgaaaacacccatatttcaagttgtgaggtattggaaattgagaataagtataatattaattttccgacaatgcttaaagaatattatttacaacataatggtgataagattagattatgtatttttacagttgatgaagaagaatttggggtagcaaagattgttgaattaaaatatggaaactgtagttttgaaaaaatagtaaaaaatgacagagaagatggaattatagataagcatctatatccattggcaagaaatgaaggtggtgattatttttattgggatgtaagagatgaaaatgtatatatgatatattgtgatgatgtggagaatccagtttgggtatgtgattctattaaagcattttttgacttaatggaaaataatcaaacataaatgattggctatataattttttgttagattcattagatggtgaacaaatagaggtgagcaaagaaatgctttcaaagcggattatattttgaagctggaaaaacgagaggaggaaaaagcaaaaaaagaagcagggcagggagaaaatataccggataatctgattacatgggtatttcaggatgactttattcccagaggaaaaatcaccaaggatgggaattacagtattataagtgactatctgggaactccagtggaagcctatgatgaagagggaaagaaatctggatatctatgggagtgtaaaaacggaggaagcattaggtgaaaagaatttaattccattccgttttcagggacagtatgaggatgaagagacgggattgaagagaggaagaccatattcaaatgctgtttcgtctaaagaggtattagttgaaggaagagtacctgcaaataagttgacaataacgtgtccaggttaactgaaaatatattactgaatgtatttttagtatgaaatattagagaagtttacaaagtaaaaaagaagagtatgtggaaatttgattatggttaaattcttataaaaagaggtaattgttttatgaatttataagaaatagaagagtgagttactatattttataagtatataaaatggttgaagttattgaagagtgtgattatagagatttctaaaggagtatttttatggatatagagcaggctatagagactatatatactggattggtaagtgaggaatctgttccagtgaaattaagagcatttcgagaattggacagggaaatgctaggacaagtgcaagaagcactttcctttgcaatagagtattacaaaggaaagtcattagtacctaaaaaattagcgatggcaatggtcgatatttttggtgcgttttgctttaatagtggttttagtgaaaaagagctgagagagcttgaggatattggaatgaaattacaggaacaagcattagagctttttgatgaataaaatagctaatcttatagttggacttgagtgaatgtagaaactattttaaaaaagtaaaactgataaaaaatacattatatgatgtctccgaattctgattgattatgccagcgaaactctggcattgaagtttgacaagtaaatattatccgaacttgattcttgttttcgaaatttcaacaccatcatgattcatttttcttccagttttgcagacagggataacggatagattttaagctgtacaatccagtcagtcaaagatgtaattatcggacaataaaaatcgccttcaatcaaaaatttaccggctgtgctagaacaaatatgctttctgattaaacaggcgcaatgcgccgcatttttgaggctgtttatcaagtgttttttgataaaaaatgggggattttaataaaaatggaatctgaaagccttatgtatagtggcttggagataccgagagattattttaatataaaaggagaagtgctatggataggattttaagtacatatagttatggtatttgtttattttcaatggaagttctacaagattttttgaaaaaagaaaaaattagatcaaaaaaattattacataaatttcaaaaggataaaaaattatatttagctatgcaaaaagaagggatttggtttcctatttcgaaaataaattcgggacaacatcttattaaactggaaggatatgataatacatttaatgatgagtgggaacaaaagtttgagattgaaggatttaatttaaaaatagaaggtggactttggatttcagatataggttccttctatacattcaatgaagctgaattttgtggggaagcaatatcgtttaagacgggggatggtgacatacaatattcagattttaaatatgatgttcctgccggaaaatacttattatcagtaaaaggttttttgagaaaggaaaaaaaaggatttcctaatccaaattcaggatttttattttctcttgtaaaagttgatgagtttagcggatttaaaaatccaagagaggacatttacaatttcaatgtgactaatatgtaacaccttataaattagatactaagacttcccatacctaaaatggggttcgtaccttgaaaattcaatatttcagctaacaaaatagtaatttatgccattgcaatctctgggtggagtgcattgcgcagatattctggtaatcttgcttcaaaatcagcagtaaaagcagtcattagtcaagaattggatacaattagtaggcttgctaaagaaaacaattggggaaagaggaaaattcaaaaagaaattagaatgttacaaagcgaagtaaaaaaaggagtgataaaatgtcattaaaattatataaaataaatacaactctaaatcatcctgattgtatggcaggatttaaaaaaaatgatgatgaaattttttcattttttagattggacataggaaatgaagaaaaaataaaaagaagaagattggagtttgttgcgggcactggttatacactggaaaatattgagaaaacagattatattttttgtccatctgcattgttgttttctaagcgatttgttgaaaaaattggaaatttattgagagaagaaatgaagtttttttcttgtagattagtttgtcaagacgttagtttagaatggtatgccgctaaaatcatactacgtatacctataatagataaagaagcatcaacatatcgtacattaagtgatggtgagagagtgttaagttttataaagtttagaagagatattgaagaggaattttttattgcgaaagataaagaaagtattacagattttgttgtaagtgaattgttcgtagatatatgcaagagaaatggtttgttaattgattttaaagaagtataggtaagaaaataaattaccagttaaagaggtagaattctgtaaaggagttaagttgccctcttggttatgaacaggtggaacgcatggagttgtgcatcgaataagagaacaaatactgggaaaaatgagaccgccaagtaaaggatggtatacacatgatgaacagatacgagcagaacttgataatttgagaaaagcgttaaatgaggcaagaagtaggggaatgtcagatgttgttaataataagtatcccaatattaataaagtatcagaactgcaacctccaaaatcgacagatgcaaaggtgccgaaaatatgtcaataaaagttaagaagccagaggtaaaaatgaatctttatgaaacagataaagatgtgttgaaaagctttattacaaatgaaaaaatagatggggtatttacggaaaaatacttaatcctacaaaattttgcggatgattgtagattttcatcagatattcagccggaattaatggaatatttattgccattttatttaagaataattgaagaggcaatcatgcatcagaataaaatggcagaagatatttatagtcagtttaattctatgattttttttaatcaacaaaattttaaaaattctgtaggagaaaaatatccatatgtaatggaatattatgttgaacagacagtgaaacggatggaaatgggaaataaaacaatactcggtgacatttctttgtttaacacaacaattgcatttgatagaaataatattgtaaagttatttgataaaatttatggaggatctttagcgataaaatattcattctttaagtatatttcagttttgctttttaaggaaagcgataatttgcttgcaataaatgaagaaaggccattttggacgagtgaaatatgggattttgatgcacagttttctgacgcttttttttggaatcaggaaattgttcaatattatgaaaggcatgtgacaagacaagagattgaggaggtatttaaggatataacaccaattttatataatagtttaggaaaggagttaatgaaccttttttcaagtgaaatggaaaagagctttgctacaggaacttttgaaaagagaaaaaaggagtatttacagaagataaattgtagaagtgaaaaatataagtattggacggagtgtttttaggaaacccaaaagggtaaaataaagcgtgtaaatttttttgattttaacccgcacatatgaacgagattattctggtcttgttacaaaaattaatcgtccgggaggcagatatacaaggtattgttatgataaactgggacgtgtgataagaactgattattatgacaaaacttatgagaactttatttataataagaatggcgctataatagaggcggaaaaccaatatggcaaggtaaagtttgaacgagattcgttgggcaggattacgaaagagtggcagggcaggcactggatatctaatcagtatgatgaattgggaaactgtattcagacagtaagcagttttggagcaaatatacttaccagtcggaatgaaatgggacagacgacacaagtggcggcatatttggataaagaaaagccgtgggtgtccaggatggaatataatgctttggggcaggagactcagcgtctgttctctaataatatctgtagtgcatgggactatgataaagctggcagaccgatttttcacgaagtaagtaatcagcgaagtaaggcagacgctgctcatcagggaatttttggaaatgttgtcggctggtcggatacattgcgcaggcacagatatgaatgggatgtgaattatcagttaaaggagtatatcctatggagggaaggaaaataagttttgtggtactggctatggcaggtctgctgacagcatgtggcagccgagtgtggggtgatgacggtgaaatttccacagcactagccttcggagaagcagaggagtgtacgcagaatgccaaaacacgggaagatacgattgttaaaatatcagactgcctttcggaacaggtgccggagattgatgactgggctgcttatgtagatctgaagagtgatgggcaggcgtatttatatcaaacatatgatcttgaaacagaggaagtatacaaagatggggcgggaagtgaatatttgggagagtattattccgttcatgtgagcgagatgtgggaggatcacagtgtgagctggagcacgttttatgtgagtgtcaattttgataaggttttatggaaggatatggtaggactggcagacagtgagtttgaagtgtatacattagaggagtggagaaattcgtcgtattatccaagccttgatgactaaacggcgttttgcatagatcctgggaggaaaataatatgataaaaaattttctttcatccattgtagtaagcttgtttttgatccttcttgtgattttgtgcagtgaaaatgataaagaagaaagcagacatgagcctcaaaatacatggttttatatgccgacacagcctgcaaataaaaagtcaaggctaaaatgaaagaactttgaaaattttatacaggttgaaaattagacatcaaaacaagaccaccacaccagtgctggtctgaaaggtatagtagataattaagattctggaagagatgcaagatattctttcactcgtccatagtagatgcgtagaaacttgttagcaccggcagtcatatagacataatacggtttcttttgagcccgttttttgtctaagaactgatacacaggatcatcttgtggatgtgttttgattaagacatccattacctgaaatagtgttttcctgaggtcagaagaacctcgttttgaagttggaacacttttctgttcataagagccggattcgttaacaccagggtctacaccggcaaaagcagtaatggcacccttgtgagtgaaacgggaaacatcaccaatctcagccatcagttgaggaccgagtgacgttccaacccctttcattgccataacaacgggatactccggaagcttggatgcagtttcgttcatgagagtgcgtagcgactcaacagtaatagaagcactgttaagttggtcaactgcctgcttgataataagctttgtaatgtcatccttaggaagtacaggaacaagctcctttgcttttccatagatttcttcagcttttgacttgctgaagttgtacttcttgcgtttgcaccagttttcatagtgatcaataaaagcgtttatggacattttacggacacagtctacatgccagtatgtagatgcaaaatcgacccatttctggctgccgtcactacgtgcaggactgtcaaaataagtattaacaccaggataggtttggtcaaggatgccgataaggttattcttcatagccgtcttgtgcttcatgtaaaagccaaactgacggttcatggttttgagttgattgcgtaattcatccataacgctatactgtttcagattttgccacttgtcaagtgcatatcgggcaattttaacagagtcagctttatctgttttgactttacgaagggaatcgttatcaaaatccttgataagctttgggttaatggcactaacgaaaagatttgcttcggaaagttgatgggcaaggacttcgtaatagcgtccggtatgctccattacaattcgggactcaccttcgatagacttgataagttttacaagcgaattgatgtcactggatgtgtgtttaatttcaaagggtgtggaaacaatttcgccaaaaggccgcataatagcaaccatacttttaccttttgaaacatcgatacctactgcgttcataaatttgtcactccttaagattattgcaatggataagtaccagttttactcattgcctattcaatctactgtggtgtgacacgaatgcacctgaggtgattcaacctgcataaaacgaacgctgcgaatgaggagctggttatcagtctgtgttacggacgcgaagtccaagaaaggagaagatatccaattgctacctacattctaacagcttaagcaacaagatggataattccttactggctgtaagggatattaaccataaatatattgtagtagaaagaagtagaatatgaaggagaataaatgcaatgtcaaacttagtaagatttgaaaaggtagataatgaattgaatattttgcgtattggaggaaaaagttttttacctcctgatgtagagtggcctactaatcctaatggagaaaaaatggtttttatttttaatatacctacaaattttttaaattcaactcttcaatttaattatccgaaggatcaggttatttctgtatttactacttataatagagaagattattttttggactcgatcgtttataacggtgatatagaagaacttcagaatataaaaaacggatatacaaaagtaattttacattctgttgcttctccaagaaatgatgcggattttttgatttcagcaagagaaatagtaattgataaagaaatgaatgaatttgatgataattatggctctctttttggtgcaaatcctgtatttttacaagaagaaaagttagaacttgcctcctatcaattttgcatgcagatatatggaggagattttccagaagaatttcaagatatcttctatttagatgatgcaataggttatctatttttaagtaaagaggaaaaagcaaatgatgttggagtattttttgtgcaatgcacctgaaatggtagtggggtgcgatttataaagaaatggaatctcttcatataatcaagggtttgtggaatttatcaaatatcggggcggaaaattctgatacaaggataaggctggaacgggattctttgggcagagcggtaaaagagtggcaggatgcgcattgggatggagtacaatgcgctggggcaggagacgagccgcctagtttccggcggtgtttacagtagctgggaatactgatacagcatcaggaaacggactggagatttctgaaaagaatggcgtcccagcttgggcttccgttagtgccggacaccagctattattatccccgtttttatcttggactgtcggaaggtgagaaaagggaatcgggagaaattccctcctgtgatatgtgttttgacggacgctattatgcagtcagtggttttataacaggggcaattggagcaaaatttccaggaatgaaccatttggtagaaggtgttgtggatacaacggtatcagcaggtgaaagacttgcgtatgcagtctttgatgacagtatgtcatgggatgagaagtgggcatatgcttttgatccaggacagatggtggcagattttgtaacaggtgttgtcataggagaaatccttgatgggataatggcagcaatacagaataggttaagaagtatttttgcaaattatgatgctgcgatgcgtgaggcttttgagagtggtaattactctagcttaagagagcttgatgttaccagaagaagttgccaggtatgacgagcattggcttgatgttgcagaaaagataagtaatgaggctcttgataatcaaattgattttattaaaaatggtggaataactaagccgggaggtggtgcatataaacctgcgaagataagtgctgctgtagatttaaatactggtgatatatattttggatataacggtgctaataagtttaatccttcaattcaagaaatacatccagatttacaacaaagaataaatagaactatgagtctggcaggaaattcaattgataatgaatatgcaagtagaatgagctttgaaaagtggagtgtagataattgtgcagaaatatattctgtaaacaatgcattacaaaatcaagcaacgttagataatatttttattaatacaaaatattttaaagatggaaaatacgctttgccgtgtcgaaattgccaagtgacatttgaaggatgtttattcccaaaacaataggaatgttaatattatggaaaaagtgacagaggagagactagtaaaagctggttgggatgaaaaaagaacaatagatatatctaatattaaagatgtgtatcagaagcttgggcttgtcatgccgatgaatgtagaaaaatttttgacggtatacggtatgcttgtttttgaagatgatgaaagaaaagaaaatttggagtttatcccagaaaaagcactgggatgcaatttggataaagtatattttgaagagttactggaagaatatgatattaatgaaatagtatatcctataggggttgcgtgtagaggaaatttaatggtgttaatgacggaacaagatgtgttttattgttatacagatgggtatttagaaaaagcaggagagaatgttgaacaaatgcttgactgtttagtaggagaatgcaatgaggcagtagtaataagttaaagatgtatcagcggtatttttaaggctctttgcttggtgctggaagtattttagccggggcgtttataggtgcgggtattggtgcattatctacgacagcgatgaaagaaggagaggagatttcgactggaaatgtccgaagtgcaggtgaaagacttgcgtatgcagtctttgatgacagtatgtcatgggatgagaagtgggcatatgcttttgaaccaggacagatggtggcagattttgtaacaggtgttgtcataggagaaatccttgatgggataatggcagcaatacagaataagttaagaagtatttttgcaaattatgatgctgcgatgcgtgaggcttttgagagtggtacagaggcagacttattcttaccagatgaattctataataagaatttgccaaatcaagtagcaccaggaaccaagtatttaccgaagtatgatgaacttggcaatgttaaacatataaaaatgtatgatgactgtggacgagaaattggttggggagattatactaatcatgggtatggagacataaactctcctcattatcatactactccacattggcatgaaaaaatatataatgcgcagtatccagatggaataaaaataaaccatagaacagatgttaatacacccttgggagataagtgatgaaagaaattatatatgaagattgtaataataatattcaatttattaaggagatgtttctcaagattggcttaatggttaaagaagagttgatgtggaatatttcgaattttgattcagttccggtcaattcagaagattatagtggtgttggaagaactgttaatgacagtaggcagagagtttatctatttcaacaaagaattttgaatgaacatactgtagtaatcggacataaagaattattaaatctgtttggtgatattagaacgatatatgaagctgtatttgttgctacaatagatggttgccaaagtgaaatctcaatttttgatggagatattataagcatacaaggcaatatcgaagattttttatagtcgcaaagggggtataagggggatgaaaagttctcgtaatacctaaacaaaaacacagaatcgggaatgttttattggcgacagccgccatggaacattctcgattttttgatacacggcaattccgataaaactgtcccgaagcataacaaattcctgaacagcagagaaagttgatttgcctgtctaaaaaatgaatttgtgcatatttacggttttttctctgcttttggtctatggcataaagccaattctgtcttcacatcgccaaagtttcctccgatttttgaaaaacaaaaattttgacttgcaactgttctttttcagagttaacatcacacaccacgaaggagatttcttctgcttcgtgtcctgtgttctacaggatgtatccatctccatgaaagtcagcggtgttcctttgcggaatattttgtgcctgaccagaagtggataggctataccactcttgcacacttggttgctgaaaagatgcgtaattccgagaaagatgcttaacagttgagattgccactattttgctattcgagtgagacatgcaggagtggataataaaatattcagtgggagcttgctcactaaggaatattttattatttgctcctatagggcgaacgccctgcatgaatattttgtcttgatacagttcatttctataaatatctgactgacaaaatatgaatgccatgtcttacgcaaagaatacttgagagaatggagcagatttttatgattaaagaaaattttatttatgtgggtatcgatttacataaagaaacccacacagcagttatgattgactgctacaatcaaaagctgggagagattactttcccaaacagaccagccgattttcctaagctggttactaaagtaaagaagtgtaataccgatggaaaagaagtagtttatggtcttgagaacgcctacggttacggcagagccttagcggtctggctaattgacaaggggtatctggttaaggatgtaaacactgctatctcacatcgacaggcaaagcatcgaggtgctatgtaccgtaagagtgacagtgatgatgtggaagccattgctctggcaactttaaatatgcttgataaacttccaaatgcgtgtcccaatgatgcgtactagtcacttggtcagctggtgcatcgtagggacaatatcatgaaacagcgaaccagactggttaatcagttgcatgagcagttgtgtattgcgtatccgtcgtataagtcattttttaatgacatcagtagacctactgcactgtacttctgggagcattatccatccagaaagtatcttaggggtaagtctgtggaagatttacgtaaggaacttgttcccgtcagccataacaaatgctccactaaaacttgcgagaaaatcttggctgcacgcttacaactattcccggtgtaaatgtcattacagcagttaagattcttgcagagattggtgatatcaaacgttttagtaatgccaataaactggcacagttcgcagggattgcaccacttcatttatcctccagcggtaaggggaaggatgtagctaccaagcagggaaacagacgactgcaggtcactatttattttcttgcaatccagatggtgcagctatcctcaaaaggcacaccaagaaatccagtagtgcgagcctactacgagaagcgtaaggcagagggaaaaaccagccagcaggcactgatttgtatttccagacgattaatcagtatcatttatggaatgtaaaaaaacggtacggagtatcgcatgccggtagtggaaaatgctggcgaaaataggtagagcaaatgtcaaatatatggtagaatttcaagcagatgcgagagtcgtctttgggaagtgtattcatttttcaaaagagaggtatcggcttggataattataagagtaaagagtctctgtcaagagtggcagtacaaccgcagatatttactcttttggtaataaattagcgccaagaggagcaagacctcaacaggactttaatgttgaaaaatttgatagtattgtaggcttaatgagtttaatgagttatacaaatcattaccatggcaatacggaggaaaaaaatgacaaatatgtatgaaacatggttgatggagcaaatacatagtattgctaattttccatatgaagatataaagatattggataaatatccattggatgtgtcaaaacaagttcttaaagttttaattgagaattcatgtttaggacaaaattatggtcctatagatattagtcgtaaaaaaatcaatgaaattaataaagattggctaaatcaatttcttcttgaggttgcgagcacgtgtattgattgttcagatgaatgggaatatagacgattagttgaattagttgttcttgtgcttcctgaattgaagcaagaagtattaaaattgggtgcacaatctgagaatgaagaagtgagagaagtagtagaagattttcaaaatttgtgaaatctgcttatgcaaaaaagaataacagttttcgtacacatacaccaatcttggatccatatcaaaattgaattagtgggtgattaatggaggtgttaaggatattggatgaaaaaaaattagaggagttggtctccaatatggatgatagaattagaatgcacgattattccaaagaacaacttttgttgttaattgaagactatgtaacaattaattttcaaggtatgaagtatcagacaagagaggcaatattgaatatgatatgtgatgctgtgaattattatgatataggaaaagatttaaattgggaatcaattattgctataagggaagatttggaagatgatttgaaagaatatgttgatgagattatttctatgcaccacaattaagcctcctcatcagccgcagcatctttgatagaaacatcttttttatggtaagtttgttgtggctcttatcttttataatttcaaagagctcatctattggggcgttctgaatgttctcaggggtgaggtactttgaccggtggcttccatgccaaagacacagggggaatcaccgatgtttttgaatataagagtggtgacgcacacctctatctattgcaggatgattgtgatataggaacgtaataaaagcaatagatagaaaaagactgcttagaaattctcaatttccgtattatggaggcaataaataatggttagtttagtatgtatcgagaagaagcaaaatatcaaattcccagaggtatatacgaaattgtatcaatcaaattttaaaggcataagtaaaatgaagatccaaatagatgaagattctataaatatcagaaaatttttaaatgcaaatgaaattaatgatgttttagatgagttttatgattattttggatatgatatagttccgattgctgaagtggaatacgaggattttatatgcttggattttagagttaacaagcaaaatccagaaatagtatattggaactatgaattggcattagaaaatccaatagaaggaataacactattgtatagtagtatggatgaattaataatcgaactgaaaaaaggatgaaagattatttttattattatgtctccacataaggacatttgaaatcaaaaaagaataatgttccatctgaatatatgtctcagcatggagtgggaaaaaaagatggtctatgtatgaatatggaaatgcctgaattatttgataaatagggaaggagaatttagtaatggacaaaaataatcacatacagcaattaatcaattcaaggaagctgagtactaacgaagaatatgaattatttgaaggtgcattacaggcgttacatatgagcatatcgattgatgatattgctgacatatgtaaagctttttgcgatgatacaaaagatgatgaagttatgtttggaattattcatctaattgaacaattgcaaggagaggaatatttaaagacgattgcaatatgcacaccagatatgaaggatgctcatgattgggcaatgacgttaaataaacgaataattaatagtcaaaaatattttgaaaaatacattgagattattggcgagttagaaaaggactataaggaaaaaatattaaaattgttagttgatgttaaaaatgataatcctaaaagatttggtaacaaaatagatatgctgattgaacggacagaataatgactttatttatgtctccacttaaggatgtccaccacctaaaactttacccacggtctttaaattaatcggaatggctctcaccgaaggtgctgtaatccatgtagattaatttgaagactctagggcaaaatttgccatctgggtgtacataaggacatccgaaatcaaaacttaatattgtttcatcaaagatgcagaacgcattgttttcatgacacttggcaggagaggagatttcgacgggaaatgtccgaagtgcaggataggagaaatccttgatgggataatggcagcaacacagaataagttaagaagtatttttgcaaattatgatgctgcgatgcgtgaggctcttgagagtggtttagatgctaatctattagatgacatgggggaatttacggaggaagtgcaatgatagaattaaattctaagattaagaatgctctaataaaaatagactttattaagcgatatgaagaattatctaataaatttaatgctgaaagaacaccttcaagtaaccggttagtttatattgagggtaaagaagttatggagacaattcaagctttaggctattctccgctgtttgatgcaaaagaaaaactatataaaatcaaggaagaacaaattggaaagattactttgggagttcatattattctgcaagatggaatggttgatttagtttgggtagtcagagagaatggagaattgcttcttggggctccttgggggacatattcaaggagactaattgatagcagttacaggataaaaaaaccaatcataggaacatatgaggatttagaagaaattttgaaaattacatttaaaatgtatgaagactttaagaatgtactaactggtaactagtacattgaataataaataactgctaattattatgaacctcatagatttattattgaggtgaaaaacagccatgaaatacagaaagaacggcggaccattagcctgtaggtaaccaatccacgtataacagagtgaccaactgccggggactgttaaactagggctcttttccaatgctgtcagaaaaacaaatgtgactggagttaagaaaaaatttcctgaaattaacccttgacaaaagtcacttcataacaggagatagacaatgaatacaatttttgagtttacggatagaaccagtgtttatagtaaatgtatatttgcttctatttgccatgcagtaatggttggaaaatatacattgttgtcagatgaaatttcttgggatggaactagttttctattccaaaatatggaaggaactagaggcgttatatccttttctgaaaagaattttttgtgtggaatacagagtgaagaaaattatttagaaggggaaaacaatatagaaaatacattgttaaaggatgctgaattagatataatttatagagtaagaggagaaatatttccatatttgcttgtcgaaaacgatggtgatgatattccagctatatctgctattttttggggagaagaagaaaaaatatgttcagacatgaacgaaaaggagtttatgcataaaagcgataatattttattgccatatctttatgaagagaaagatatgaaaaaatattggagagattattatgaaatgaatcaggagcatgagcaaattgtagaagaattgtatctaaaaaaaatgacaaatgatagttttttattggatgctgtacaaaaagaaaaattaatggaatggtttggcgaagaaataacatattgcaaacaatctttagaggaaattggaattatgtttgactaatctaaggatttttaattatggttatactttcggactcccaacaacctacaactcctgcatgtctattaattaaccatcatggctgttgcgaagcaattaagaatccatgatgttaattaatagacactagcgaaattttgccgagttgggtatacggacgaacatagcgaatttaatatgctaatgtaacgcaatcttagcaacagaatgctgcgaaagggtgcgtttttctgtgaaagtttactataaacggatataaaaattggtcaaaaaagcggtaatttagactcaaatattgtttcgaaaggcggtaaattaggaggcattatgtcagtagtagataataaaacggtagatggagtagcattaacggatgataagaaaggtattattttattaataacagaccatttagagtgaaaagatgaatatcaacatttgataatgctacaagcaaaaattaatgcatatatttcatttttagaggaaaaacaatataaagatatataccaagacatgagtattatgtatggaattatagaaatacattttctacattgtttaactaaaaatgcggaaaagtttttgcattcagttaataatcaattaaacgaattgggtataaaaatacaatattctgttttgcaaggagaagataatgaagttagataaagaacaacaaaagcattttgctgaagcaatacgcaatgcttctaagaagaaaggatttaaagtaaagggctgttctatatatgatgacattttttggaaagtattacaaatgccaagtaatagtaaacaagctgattcactaagagcagttggggcatttaaagctccgtcaattttaatagaaaaaggtcaagatataaaacaggaattacttcacagatataaaacaatattacctgatgaattaataaaaatatgggaagataatggattggcaagattgatgggaggatatctaaaagtagtaaatccagaagattatcaggaactgcttaaggaaacatattttagaggaaatatttcgattccgatactagtgacggcttttggggatatagtaacatttgaagaagaccaatatattggtatggtgaagtacaaaaatggtaatttcgtcatgctcgcaaaaaattttaaacgttttatacaaaaccttggagatgactattttttagaaaagtattttcagataccccagtatatagaagcagtaaataaattaggtaaactggagcaggatgagtgctttggttatgtgccattattgggattaggtggtagcgaaaagattcaaaatctgaaaaaagtaaaaattagagaatacattgaattaatatcacagctggtgggaaaaattggaatgtagtaatgtttataaaggaaaaatagtttaaaataagtatttgatctaagttccgggatatggtctcgtacgacctgacgacctcaatgcccgaatacgcagacggaacgagggggattacgcaggaggatgtggatgaactgaaccggatactgtggaagtatgagataaacacgcccaaccgtattgcacattttttggcacaatgcgctgttgagtcgcaaagaggatatggcagggtggagcaatataacccgcccgatccgattacttatttcacgggagaatatgaaaataataatagagcaaagaatcttggcaataccgagaagggagatggccctttattcagtggagcaggggcaatacatattaccggaagagcaaattatcaggcgttcagtgattatatgggagatgagcgcattatcacggatggagcgctttatgtagggcaaaactattattgggaatccgcagggttttactggagcattgggaaaccgaggacagcgaatgatgataggtatgatttaaataagaaatgtgatgaaaatgcgagtgtggaggtaattacacgcattatcaatggaggaaaatcgaagctggaggaaagagaaaaggcatacgcatatttttcggaggtaattcaatgaaaacaatccaaaaagcaataaaaaaaagatggttttttagaaataatgtggttaataaatctcgcaccattggtgcgagaaatggagatggatatggaaaaaagtgaaattgtgggatatgagccgttggtcaatgacttaaagctattgataaataaaaagcaatatcatgttttgaaaatgataaatgcggagactattaatttatattgggaaattggagaagagatttataaacaacaagaacaaaatggatggggaaaatctattgtacaagtattgtcaaaagaattacagaaagaatttccgggagcaaaaggttattcagccgctaatctgtggagaatgcgtaatttttacttgacttatcgtgattctgaaaaactcgcaccattggtgcgagaaattagctggagcaataatataattatcatggagaaatgcaaagatgatttacaaagagaattttatattcagatgacaaagcgatatggttggacaaagcgtgtattgactaattttattgaagcacaaacatatgaaaaatatttgttgaatcagaccaattttgatttaacattaaccgaagagagaagagtacaggcaaaattagcagtaaaggacgaatatacctttgattttgcggaactctcaccggaatattcagaacacgagctggaaatgcagttagtaaacaatattaggtcatttttgatagaaatgggtggtgattttacatttattggaaatcaataccatttgatgataggaagcagggatttatatattgatctattgctttttcatagaaggttgagaagtctgatagccatagagttaaaaataggtgaatttgaagcagaatatgctggaaagatgcagatgtatttgacggcattggatgaacaagttaaattgcctgacgagaatccatctattggtattattatttgtaagagcaaggataaaatgtatgtagaatatgccttgaagcaaataaatgcaccgattggggtggctacatatcagttacgaaatacactaccagaagagatgaaagcaatgttgccggaaccggaggagattgttaagaggttgaggatatttgagaaagaatgaaatgagaaaaatgttacatccttagaatattgtgatatacaaaaatgataaaaattggagacatgataatgaggattttactagtagaacctaattataaaaacaaatatccgccaatgggattgatgaagataagtacataccataaagggcgtggggatgaagtgactttttacaagggggttatggattcagcggaattttatggaaagcattatgatagggtatatataacatcattgtttacgttttattataatcagactgtaaaaacaataaagagttatgaaaaacttatttcgccagagattaactgattcaagcattttggggttaggtgattctgtaaatattgatatacttccgttagactattccattttggatgatatagtatataagtatccggcaggggataattattttgcttatattagtcgaggttgtacaaacaagtgtagcttttgtgcagttccgatactggaacctgaattttgtatgactaataatatagtacaataagttaaaacaataggtgaggagttcggagaaaaaaagaatttattgtgtatgaataatattacaaaaaatagattgattgattcaggttggaaagaacaacgaaaaattaatactgacgcagagaccatatacaaacagctgcgtgaaaaagaagagtagctggcagcggttcttccacaaccgtgagtcccataacgcaaattgcagattctgtggtgcaattcatagcgtaaatcgggcatgtataagcgtcctctcacaagtcattcgtaacgtaaatgaaagaaaaacggtgcagacaaatatgatttcctttgtgagccatggagataagactcttcagaggcttatcggaatgtccggcgagcaggaacatcatatttcgtctgtaccgtttttcttttcataaacctataaaatcacgacttgcgagaggatgcttatatctgcccttcaagccctaagaaagcaccacagaatctgcgacactacgctaattaaactccggtttataactccggcaggagttttaaaaattcttccgtagactgtgatactggcaaagttggatttatggaagctaccatctgacgggatggtagtttttcttttgttttcacaacatataggtctttggattcccggcttaagcagtagtccgggataaaggcaattccaagtccgatgcgggcaaggtcaattaacaggtcattactgcttaattccacttccgggattaactctaactgatgctgtaaaaacaggttgtgcagaaattcacttgtggtactcttgcggtcaagcatgagaatcggatactgtttcagttcttcaaacggaatctcctgctgtttcagattgaagtaggcagggttcgcaatgaaaacatcggtaaaattgcagactgttttctgaatataggaatgattcaaatgtgcatttgggaagttcgtcacgatcagatccacttttccctgctctaagagatccacacagcttacagaagttgcattggttactttgattggcacatttggaaacttcttgtggaactgctttaaataaggaactaaaaagtaacggcagatcgtatcgctggcaccgatgtggagctgtccaagtccaaggctgccagaatcgagaagctggctctcaccgcgctggattaagttcatggcaggctcaatgtgctttaagagtacttttccggcaggggtgagctgtacttttttcgtgctccggatgaaaagaggctgctctaattttttctccaatgtcttgatcgactggctgacagccgactgtgaaatgtataactgtttacttgcctcggaaaaactcaaagaggttgcaacataataaaaaactttatataactcgtagttgatatccataaaaatgcgtgtacctttccaataaggtttccaggttagagaaaacctcagattataatgagcgtatatacagactgatgtgcctgaatagatataattataagacgtacttataattgtgtcaatcgattcttatgattaaatgagtgtgaagtgtgcgtgataaatagtagattaaatattaaatgaacttataaaacaaattaaatatattaattatgctaatctaataccatatgttatactatcctaagattgaatcgcaatgactcagtacgtcataattgcgaagcgtaatatctggcgtggcagaaaaaatcatgccagaagcagaataaaagaaaacatatcgcgaaaggaaaagggaacatttatgagcaaggtaagaagagtttatgtagaaaagaaaccggcttttgcagtcaaggcaaaagagttacaggctgagattaagagctatcttggaatttcttccgtgacaggtgtacgtgaactgattcgttatgatatagaaaatatttcagaggagacctacaagaaggcactggtcactgttttttcagagccgccggtagatacggttttcgaggaaaccttcgaacttggcaatgcaaaaactttttctgtagaatatttaccgggacagtttgatcagagagcagattccgcagaacagtgtgtaaaattattaaacgaagaggaagagccggtcatccgcaccgcaacaacctacgtgatcgagggcgaagtgacagaggagcagttggaggcgatcaagcatcactgcatcaacccggttgattccagagagacaggtcttgagaaaccggagactttggtacagaattttgaagatcctgcagatgtgatctcttttgtgggatttgcagatatgccggaagcacagttgaaagagctttacagttctttaaatcttgctatgacattcaaggatttcttacatatccagaattactttaaaaaggaagaacacagagatccatccgtaacagagatccgtgttcttgatacctactggtcagaccactgccgtcatacgacattctccacagagttaaaggacgtgaagtttgatgatggattttacaaaaaaccgatcgaagagacttacaatgactatctgaatacattcaaaaatctttacgaaggacgttccgacaagtttgtctgcttaatggatatcgcattacttgccatgaagcgcctgaaaaaagaaggaaaattacaggatcaggaagaatccgatgagatcaacgcatgctctatcgtagttccggtagaagtggacggacagacagaagaatggcttgtaaacttcaaaaatgagactcataaccacccgacagagatcgaaccgttcggtggtgcagctacctgtctcggtggtgcgatccgtgatccgttgtcaggacgtacttatgtataccaggcaatgcgtgtgacaggagcagcagacccgactgtatctgtgaaagacacgttgccgggaaaacttccacagaagaaaattgtccgcgaggcagctcacggttacagttcctatggtaaccagattggacttgcaaccggttatgtaaaagaagtatatcatccagattatgtcgcaaaacgtatggagatcggtgccgttatgggcgctgctccaagacgtgcagttcagagactgacttctgatccgggcgatatcattatcttactcggaggacgtaccggacgtgacggtatcggtggtgcaacaggttcatccaaggcacataatacacagtccacttctgtctgcggtgcagaagtacagaaaggtaatgctccgacagagcgtaagatccagagattattccgccgtgaggaagttgcccacatcataaaaaaatgtaacgatttcggtgcgggcggtgtgtctgtggcaatcggtgagttagcagacggacttcgcattaatttagataaagtcccgaaaaaatacgcaggacttgacggaacagagcttgcaatctctgaatcccaggagcgtatggcagttgttgtagctccggaggatgtacagaccttcttaggctacgcagctgaggagaacttagaggctgtggaagttgcagttgtaacagaggatccaagacttgtattagagtggagaggaaaagagatcgtaaatctttccagagcattcttagatacaaacggtgcacatcaggagaccaacgtagaagttgagatgcctgaggaaaaagaaaattatttcaaaaagatcgcagcaccaaaggtagcagaggcagttgcggcaaatgatatgaaagctgcatggatgacagagcttgcagacttaaatgtctgctcccagaaaggtcttgtggagatgttcgacggttccatcggtgtgaacagcgtttacatgccattcggtggaaaataccagcttacagagacacagtccatggttgcaaagcttccggttgcaaagggagactgcgataccgtgaccatgatgtcttatggttttgatccatacttatcaagctggagcccataccacggagcagtttatgcagtattagagtctttatccagaatcgtgactgccggtggtgattacaagaaagtacgtttcactttccaggagtacttccgcagaatgagcgaagatccaaaacgctggagccagccatttgcagcattactcggtgcttacaatgcacagatcggcttcggacttccatctatcggtggaaaagattccatgtccggaaccttcaatgatattgatgttccaccaacactcgtttccttcgctgtggatatcgcaaaagaaaaagatatcatcacaccggaattaaaagcagtgggagaccagttagtactgtttacaattaaaaaagatgaatttgaccttccggattacgcacaggtcatgaaattatacgataccatccatgcactgatccaggctggcgtgatcgtatccgcttatgcacttgacggaaaaggacttgtagcagcagtcagcaaaatggcattcggtaacaagcttggtgttacagtaaatgaagatgtttccaaagaaacattattcgctccgggattcggtaacattgtggcagaagttccggctgaaaaagttgcagaggtaaaagcagcattcgatgcagcaggacttgcaggatacgaagcacttgtcggatgggtaaatgaagaagaaagctttatttacggtgacatgagaatttccatggaggaagcattacacgcatggacagctacgttggaaaaagttttcccaacccgtgcaacagagaataaggatgaagttaaaacaggattatacaaagcggacaacatttatgtatgcaaaaacaaagtggcaaaaccaactgtattcatccctgtattcccgggaactaactgcgagtacgacagtgcagatgcgtttgagcgtgcaggtgccaataccatcgttaaggtattcaaaaacatgaatgcaaatgacatccgtgaatctgtagatgagtttgtaaaagcaatcgaacagtcccagatcattatgttcccaggcggattctccgccggtgacgaaccggacggctctgcaaaattctttgcgactgcattccgcaatgcgaagatgacagaggcagtcatgaagctgttaaatgagagagacggacttgcacttggtatctgtaacggattccaggcactgatcaaattaggattagttccacacggagagatctgtccacagtcagctgagtcaccgactctgacatacaacaccatcggacgtcatgtgagcaaaatggtttacacaaaagttgtttccaacaagtccccatggttacagggtgcagagcttggaaaagtatattgcaatccggcatcccatggcgaaggccgtttcgtagcaccacaggagtggctcgacaagctctttgcaaacggacaggttgctacccagtatgtgaatgaagcaggagttccaaccatggatgaagagtggaatgtcaacggttcctacatggcaattgagggtatcacaagcccggacggacgtgtgcttggtaagatggctcattcagagcgtcgtgacagaagcgttgcgatgaacatttatggtgagcaggatatcaagatttttgaatccggtgtggcttacttcaaataaaacaggcaatattatttataaaagatgaaaaagactttgtggagtgtataaactctgcaaggtcttttttacgtcttacggtacaaactttaccacttacatgaaagctatttacaaatataacaccattttctatactgagatagtcgataaggacaacgaaaacttgaaaggtaaagggaaaaggaatgaaggttacatccagcagactgatcgaacagaaaaaaccgatcctgaaacaattattagatagattgctgcagacatattcgtatgcatccattctgatgacagattcaaaaggcaaacagtacaccatttcaaaacagggaatcagcatcacggagaacatgtttgtggagttaggatatgtggtaaaagtatacgatggcgagagctatggagaatatgcgttcagccacattgatgagaatgagattgacaccattgcagaggaagtaaaaaatcatgtgatgccgtgggcaaaaaagcttccggatgacatgaaagtgaaacagtatccagaaattccggacgaagcatatcattttgaaaaaagcactgactatgaagttttgccggaagaattaggcgatgaggagatcgtaaaacgccttggcgcagtgcgtgaaaaagcaatggcacaggatgaaaaaatcgttgagatcaagacagcatgcgtttaccagatttatcacaaattatttttatctccaaacaaagacatgacgcagaacgtcatgtggacaaacggcatgatcatgggactgatcccgaagggcgaggagatgaagatggcgtttgacagctgctccggctgtggtggaatggaaattttagatgacatggaaacaaaaatcccaccattagtgcagaaactcaatgatcttgccacaagtgaaccaatcacaccgggcgagtatgactgcatctgtgcaccggatgtcacaggcatgatcgtgcatgaagcattcggacacggtgttgagatggatatgtttgtgaaaaaacgtgcgctggcagaaaaatacattggcgaatatgtggcatccccattagttaccatgcatgacggtgctgcagcagcatctgagaccgcaactttcttttttgatgatgagggaacacttgcgcaggataccgtcatcattgataaaggaatcttaaagaccggaatctgtgatgcacaggctgctatggcacttggcacaaaaccgaccggaaacggaagaagggaaaagaacagccacaaagcgtacacgcggatgacgaatacattctttgagccgggcacagataaagtggaagatatgatcgcctctatttcctatggcttttatctggaaaatgcgagcagcggcatggaagatccgaaaaactggggaatccagtgcttagttgacattgcaagagaaatcaaagacggtaaatttaccggaaaagtattttctccgatcgtactgaccggatatgtcccggacttgttaaaatccatttccatgatgtcagatgagtgtgaacttgcaggaaccggctactgtggaaaaggacacaaagaatgggtaaaagtgtcggacggcggcccatatatcaaagccagaatcagattgggataaaaaggagagagacagatgcgtgaaaaaatattacaggcaattcggaaatttcagatagaaacctaccttgtgacagagaaaacagtcgagggtgcagaactttattttataaaaaaagaacttgatatgcgcaggatgaaacaggatgcggtgtctgcggttaccatttaccgtgattttgaggcagacggaaagaaaatgcgtggttccgcaaatatcaacatttttccggagatgacacaggaggaagtagataaggcggtaaaaggtgcttattacgcagcttcctttgtaaaaaatccattttttgaacttccaaaagggaaaaaagaggataaagtgcaggtaaaaagcacactttgtggaaaaagccttgaggagatcggagatgcatttgtaaaagcgctttactgcgtggatgtgcaggacgatgcatttatcaatacggctgagtttttcatggaaaaaacgacgactgcgatttacaattcagagggtattgatgtttcctatgaaaaaaacagtgtgaacggagagtttgtcgtacagtgtatcacaccacaggatgtcgagcagtatcaggagttcgcatatgatgatcttgacacagaggcactgacggcacaggcaaaagaagcattggaacgggtatgcgacagggcaagggcgacagaagcaccggaaaaaggaaactataagctgcttctttccgaaaaaaatgtgcgcacactgatcgatttttacatggaccggtcatcctccggcatggtctatccgggttattctaactatcaggcaggaatggatgtgcagggagaaaaagtgcagggagaaaaattaaatatcacgctccatgcatccaatccttattcaagtgagggaatcccgatgaaagatcttacactattaaaagagggagaactgaaggcaattcatggaaatgcccggtttgcatactatttaggtgtcgagccgaccggaatctacagtgcggtaaaactggataatggcacaaaagcttttgaggagatgaaaaaagaaccatacctttatgtggtaagtttttctgacttctccatggatagcttaagcggatattttggcggcgagatccgtctggcatatctttctgacggtgagaaagtgacaccggtaaccggaggttccgtcagcggcaatctgttggaattacagaaagatatggcattttccaccgagcgttataaagataaagattatgacggaccatttgcggtcgaatttcatggggtagcggtcgcaggaaaataaggttttcatgatggcgaacatgagatgcaaggtaaataaaagcagaaaacaaaaaggaacattacataaatggaaccaaaaaagtttccgtttatgtaatgttcttttttggtggaggcagataaaatggagaagaaaaacaaatgaagaggagagaaaaacatgaagaaaaatctgaaaaacaaaatcaaaaagatggttgcaggaatgatgcttgcctgttcactgcttacattgtttggtggagtaagcagtgatgggattgtgccttatggagaaactgtaattgatggggttcaatggattgcctaaaccagagtgatatcaaaatctttcaataagtattcttttagaacatcggaatttggtttagtttcataaagctcctgaatagcgcaggcataatgaccataacattttaccatagtatagttgtgaacttctccaagagcctgcgcataataaaaaaagaagtatcctaaattgcataagactttcttttgagcactaaaatatttttcggagaataaatctaataatttgtaaaaatgtttgtctatgtacaaatttgtgcaaaaaaatgtcaaaacaggcgaaagaaaagtggctgtaaaacaaatatcaaatgaatttaatccgcaatagtcaagaattttagaaaaatataaaatacttttatttgggtcaattgattgatagttaatagcaatatttgttaagagtgaaagttctgcccatgataatcgataattataaataagatgtatatcaaaatctggcagagtgtatgataatgcatttgacaaaatttttattttttcctgagaagatagtgtactgtttattgcgtaacttaaatcaaataattgttttggtaaaacatctttttgagtaagtacagaacctaattggcttaaatgcagtgacacggtatcaatctgatattttggagtatgcattaacttaaattttaattcatagattttactttcacgttcgcttccccagaaagtaaaaccgcgttctgatctgccaagccgctgtaataaagcctctgttaaaaagatatctggctgcagggtgtcattttcaatttttgaaagcttggatttcgaacataatccctgacataatacaatctgtgaaatactctgttcggtacgaaggtcatgaattaatctgccaattgttaaaatgtcaggggagaaaaagtcataagtaccatctgttaaatcagaggtgtttatggcttttttgattggaaaaataatcagaggaatatcatccatttgtgccaggtaatcatctagtgaaaacagatgtctgcttaaaacatagtttctgcaaatggtggcatagcagctttcaatggaatgagccgcataaaaggtattcttaaaataggtgtaggcagtttcaatttcgccagtataatagtaacccagagaagtcagaaaagttaattccaataaagcggaatcatcagaattctgtaccattttgtggcggttactgtctgctatggaaagagcctcgttgtaatctttcatttctaataaatattttgtgtagacaatggcgtattgtgcatataaagaatcttttttcaggtaatcgatttcagcgtttgcaagataggaagcaatttgtgaacagatgttataacaaagatcgctttttcccagataaagtaattcctgtgcaactccaataagcagttcgatttcaacaatagataataaaagatgatgaaaatctgaatagtcaatttcaggacgtgttatatggagcgcggaagaaaaaaggtcataaagggcatgatggtctgcacagccagagcacacctgaatctgaccgtttaaataaagatattcctgataatagagtttgttatctgcaaagttccattcttccagcttatttaattcctcatatgcctgacttaactgccaggaacccagatagaagcgcgcacgattgagggtatagaaacagtcaaagtctgttctgcttgcaaagatcgggtaaacttcgcagggagcacccgcatgagccataagtgcttgaaatgtgacaggactgacaccggcggaaccattttcgattcttgaaagagagagaacagaacataccccttcggataactgttcctgtgttaaccccgctttgatccgtgcttcgcggattgtttttcctgcatttctgacactcatttgtaataacctctaatcaacatatattttaagataaattatatagcgggaagaagaaaaagacaatgtatatcaatcaatttgatatatacataaatggaaacttttttgtttctggttacttattttacaaatttgtgcggagcttgtataatgaaaaaaggcgaaaagaagaaaggaataaaaagtgttgtatgaaacaggaaagtaaggtcggctaccgtgatatctttcggcagaccgagtacatgaaaattatgatagcggcattgatcaatcgtttcggagattccattgacgcaattgcatccacatggattgtctatgaaatcacaggaaatgccgcatggtcggctatcatttatggtgtgaatagaatcccatctattatcattacgccgttagccggagcatgggtagaggggcagaaaaagaaaacaattatgattgtcacggatttgatacgtgcggtctgtgttgcatttgtggcaaccgggtatctgttcggatttttacaggcatggatgctgctggttacaactttgacgatttctacggtagaggcattccggggaccggcaagtgctgcattgacgccaaaggtgctggaaaaagaatactatgaatatggaatatcgttatcgacaaccttgtcaagtatggtagaattaatcggaacggctgttgcagcggcaattatagctgtaattggaacttccggtgcaatttacgtggatatgacaacttttttgctgtccgcactgatcattgtatttgtaaatacaaaagagcaggggcttgtcaagcagaaatttgaccgtaaggcatatgtgaaagatctggcagatggattttcttatgtgaaaaaagatgcaatgatccgcatttttttacttttggcggtttttttgaatgcaattttagttccattgaatagtttgcaggcaccccttgccggtgatatattgggcggtggagcggagatattatcgattcttggaatctccataaccgtaggtatgctgcttggctccgtcacttatccaatggtacagcgtattatttcgggaaagggactttggattgcgagtggtttggggattgctttgttttatattatgctcccggtatgcagaccgctttatacaagccggattttggtttatgcgtttaccgcagtatttagctttattctgggatatacggtggcattggtaaattcgcatttgagtgtgtttgcagtaaaaagaatccgcacagactaccttgccagaatatccggcattacaaccgcggcaggtgcagcatccatgcctgtggcatcgtttctggtgagtatcgttgttgcatatgtggatacatcagcaatatttattacttccggtgtgctggcactgatcgtgactgtgtgcatgtttttttccagaacacttggacaaggggaaactgatacggttgcagaagatgtagaaatggtgcgatcatgaattgggattaatattgaattgacacgatatagagcattatggcattagtaaaggaagtgagtataagcatcatcgagggcatgtgaaaaagcagggatcagagccgggtatataaggagaaaaacattgaacacgtatatatataaaacaaaaaaatatattatcgcccagattttatgggatttggcaggtgttatctgtctggctttttcaccgttgcttcaacaatggctgtttgattatgggctgcaaagccctctcaaaaagatcgtgatggtggtattggcgtatggtgcattactggtcttttatactttatcacagtatttttgtgcgttgtatgcatttaaaggcggaataaaattcgaaaatttactgaaaagagattttttgtattctttgtttcatatggaaccatcaagattctataagcattccattggcgaatatgtttccttacagggaaatgatattacagcgttagaacaggattatctggaacctgttattagtatcatacgctgcgtaaacatgataattgtgtatggtgtcgtgctgtttttcggagttgactggagaattgcgctggtgataattctgacttcgatatttgcgatcctgataccgagaatgataggaaaatcgttgaccgacgcaagaagtacatatcaggaacagatggcggagtacgttacggagattacggatttattggaaggttttcgtgttatcaatcagatgacggtaggaaaaatactggataagcatgaacacgttttaaatgaaacggcagaaaagcggtatcagtatggaaaaaagaagagcatggtattaggcgtgagtgaattaacgactaaattcgtgaaaatatttacatttgcagtggtggcagttcttttttataagcatgagatcacagtgggagtcggagttgccacacttagttatgtatcttctttcatcgaaccgatcgacactgtcctctataatttcacggcaatacagtccatgaaggacgtgaagaaaaaagtattagcttatacgcaggatacgcatgtcacagtcctgccacgaaagaaaaaattaaattcagatataatattcgaaaatgtgacattcaaaaggaaaagttttgcattggaaagtataaatttaacaataaaaaaaggcatgaagtatgccgttatcggacacagcggagcaggaaaatcaaccttgttcaaacttattatggggtatgaaaaaaacagttccggcgttatcagattagatggagaagatatcaaaaactatgacatttctgaattaatatcctataccgatcagaacgaacatatttacagagcggggatcgtagataatataaccgtttttcattcttatccaatggatgggatcgacagcgtaggaaagagtatctggccggaattttttgaagagatattcagcagaaaagaaaaagaatgtcagcgttttagtggaggggaaaagcaggcagtcgcatttttgcgtatggcagccaaaaatgcagaggtgatccttctcgatgagccgttttctgcaatggatgcaaaaatgaaatcggcagtagaacattatctgtttacaggaaaagagtttgaaggaaaaaccgttttagtcattacacatgatacaagagaagaaagcctttcgcagtatgatggaatcatacatgttggagagaatggcatttatgtggaataaatgcctgttacatttgatatttacccggaattcattgaggctaaattgcattgggtagatacgattgaaagggcatatgaagaaaaactcttggaagaaaagtggtcaagaaataagacactgcaacgttaaaaaaagaaaataaattttttttcagaattggaaaatacgatctgtaaactgaatgaagtttttggtgagcaagaagaatatcataaaagtctggaagaattaataacggcatatggaacaagaagaattcatacaaaagattcaacagcatggatcaactttagaggatgttattacaaaaataatggatatcattactgcgtttgatatttatgaggattattattactggccactaattaggacatagggggatatggaaattaataacaaatatgattcagaacatatggataatcgcaatttcataataaaatgacacagatattgacacaatatatataaatatggtactctcttaaaaagaggtgagaaaatgttaaaaacttatctgatggaaaattatggatataatgaacctatttttttgaatgacttgacaattcagggattgtctgaaaatgcagttcggcaggccgtgaaacgacttgttgctaatggttttttggaacggtatgataatggaatctattatattccaaagcgtgacggattacttgggaagagttatcttgatccgtcgctggttattatgcgcaaatatatacaaagtaaatcagagatttatgggtatgtcacaggagaatcatttgccaatcagttaggattaacaacgcagatgccagcggtgattgaagtggttacaaatcgtgaggcgacgaatggccgtactataacagtgggaagtgaaagagttagaataaaaaaggctccgattatggtttcagattcgaatgctgatcttctacagttacttgacagtattggacaggcagaaaagtacacggagctgtcaattcatgagacaatagatatattgatttcttatgtgagaaagaaatgttttacgaaagatcagttgtcggaagtgattccggcattaactggtgcaacggcaaagaaattgatcgaatggggaatgatttatgaatttgcatcatgatgaagtaagaaaacagcgttcaacattagcagtttgtccatcagcaaaagaaaatgtatgtgtgacggatattttatatgaaattatagaaaaagagacttataaaaaagattatgaggaaataacattaggcttgctatttgtgccagaaacctacgatacagttattcaaagcataaaaaagattgcagatagtggaatctggaattagaataaatggcggattttacaccgccactttttctattcaatcctcacaaactccggctttctctcccggaacaccgtaaagtaatcaaagccggcgtcttttaatatagaaggaacttttgcaaaatcaaatgcaacatgttccggtttgtgggcgtcggcaccaatcgtgataatctcgccgcctaactcacggtaacgccggatgatctcttcggttggattcgggtgcccaagaccgtacttgaagccaccggtgttcagctcaatcccttttccgagggagataagttttcgtaaaatctcatcgatcacatcctgatattctctccagtcataattttcattggaggtcggaccgtagcggacaacatagtcgaggtgtccatatacgtcgaaatcatggtaactttctatattttcaaggattgattcaaaatattcgcggtaggcggctttctctgttcgtttttcataaaaagccgcataatatgggtcgagtccatgcacaacatgggaggaacctatgacaaaatcaaatgggtactgcgataaaatatccgtgtacagcgcagctagatgcggctgtaagccaagctcaatgccgaggcgtaccggaagctttgcggcatatttttcctgataggcaagtacggacgaagtataatttggcagatcgagaagaaaaatatccggttcctcaggataatcaatatcaagatgatctgtaaagcagatcccggcaagtcctttttcgatagcagaagagatcatttcttcctgcggggcttcactgtccccggaaaactggctgtgcatgtgtgtgtcccagagccggtaatgcgaaaatttggtttccataaaatctatattcctttccgtgaaaaaattattagtaaaattaataattaaaaatttctaaaaatacagcggctaagttataataaaacgcctgtatcatgcattaatctgatatctaatataacttattttacaagaaaatggaatagattgtacgtgattttgtacaaagtgaatgaaaaacatagtcgaaaaataaatatagtgaaaaatttaacaaactcatgaaaaacacttgaactttatacagaaattggttaaaataaaggaagcttgggaacaatagttttccaaaagtatattttatacaattctaggaggaatttaaaatggcagtaagagtagcaattaatggatttggccgtattggtcgtcttgctttcagacagatgttcggagcagaaggatatgaagtagtagcaatcaatgatttaacaagcccaaagatgttagcacacttgttaaaatatgattcttctcagggaaaatatgagcacgctgatgaagtatcttacacagatgattctatcatcgtttgcggaaaagaaatcaaaatctacgcattcccagatgcaaacaactgcccatggggtgaattaaaagttgacgttgtattagagtgttctggattctacacaagcaaagagaaagctcaggctcatatcaatgcaggtgcaagaaaagttgttatctccgctccagctggtaacgatcttccaacaatcgtttacaacacaaaccatgagacattaaaaccaacagatacaattatttctgcagcttcctgtacaacaaactgcttagcacctatggctgatgcattaaacaaatatgcaccaatccagtctggtatcatggtaacaatccatgcttacacaggtgatcagatgactcttgacggaccacagagaaaaggtgatttaagaagatcccgtgcagcagcagttaacatcgttcctaacagcacaggtgctgcaaaagctatcggattagttatcccagaattaaacggaaaattaatcggatctgcacagcgtgtaccaaccccaacaggttctacaacaatcttaacagcagttgttaaaaaagctggtgttacaaaagaagatatcaatgcagctatgaaagcagcagctaacgagtctttcggatacaacgaagacgaaatcgtatcttctgatatcgttggaatgagatttggttctttattcgacgctacacagacaatggttaaccaggtatctgatgatcagtacgaagtacaggttgtttcttggtatgataacgagaacagctacacatctcagatggttcgtacaatcaaatacttctctgagttagcataatcagaacgtacaatcactgcacggtagactacttttttaagcgacaggctgccagagtgcagataagactcagcaaaggggtccggtctttttggaccgggctcctttttgctattgaataaaaataaaggagactacttaatatgtcattaaataaaaaatccgtagatgatatcaatgtaaaaggacttcgtgtactttgcagatgtgacttcaatgtacctttgaaagatggaaagatcacagacgagaaccgtcttgttgcagcacttccaacaatcaagaaattaatcgctgacggcggaaaagtaattctctgctctcatttaggaaaagtaaaaacagaagaagataaaaagacaaaaacacttgctccagtagcagtaagactttctgagttattaggacaggaagtaaaattcgtagctgatccggaagtagtcggaccaaacgcaagagcagcagtagaagctatgaaagacggcgaagttattttacttgagaatacacgtttcagaccggaagagacaaagaacggagaggcattctccaaagacctcgcttctatctgtgatgtattcgtaaacgatgcattcggtacagcccacagagcacactgctctaacgtaggtgttgcacagttagttgacacagcagttgttggttacttaatgcagaaagagatcgacttcttaggaaatgcagttgaaaatccggtaagacctttcgttgcaatccttggtggtgcaaaagttgctgataaattaaacgttatctctaacttacttgagaaatgtgatactcttatcatcggtggtggtatggcttacacattcttaaaagcaaaaggatatgagatcggtttatctttagtagatgacagcaagattgattactgtaaagaaatgatggagaaagctgagaagcttggtaaaaaattattattaccggttgacgctgtaacaatcaaagatttccctaacccaatcgatgctccggttgaagtagaagtttatgactctgacaaaatgccggctgaccgtgagggatgtgatatcggacctaagactcaggctctctttgctgatgcagttaagactgctaaaacagttgtatggaacggacctatgggtgtattcgagaacccgacacttgcagcaggtaccattgctgtagcaaaagctttagcagatacagacgctacaacaatcatcggtggtggtgattccgcagcagcagtgaaccagttaggattcggtgacaagatgacacatatttctaccggtggtggagcttctcttgaattcttagagggtaaagaattaccaggcgttgcagctgctaatgatagatgagataagcggattgagaataagtaagtgatcttgtgcgcatgcttgcatgcagtcacatgattgcttacttatttgagagcgcaacgcgcgcgaggaaactcggagagttttcgagcaatccgcggatgtaaaaaaattcgagaaagaaggaaagatataatggcaagaaagaaaatcgtagccggaaactggaaaatgaacatgactccaagccaggctgtaaaattagtagaagagttaaaaccacttgtagtaagtgatgacgtagaagttgtttactgtgtacctgcaatcgatatcgttccggttgtagaggcagtaaaaggaaccaacgtagcagttggagctgagaatatgtacttcgaagaaaaaggtgcatatacaggagaaatctccgcagagatgttagtagacgcaggcgtaaaatatgttgtattaggacactctgagagacgtgattacttcaaagaagatgatgttttattaaataaaaaagtattaaaggctttcgaaaaaggacttacaccaatcctttgctgtggcgagacattagagcagagagagatgggaatcactctggactggatccgtttacagatcaaatccgatctgaaagacgtaacagcagagcaggttgcttccatggtaatcgcttacgagccaatctgggcaatcggaacaggtaagacagctacaaccgagcaggctgaagaagtttgtaaagcaatccgtgagtgcattgcagaagtatatggaacagacacagctgaggcagtccgtatccagtacggtggatctgtaaatgcaggtaatgcagcagaattatttgcacagccggatatcgatggtggtttagtaggtggagcttccttaaaagctgacttcggtaagatcgttaattacaaataaaacttcatttgtaggaaaatagacacctgtttggcaggttttaaaatttacaaagtaagtttataagcgaacgggttttttatcagaagtggtagaaaacccgttttaaataagttataattctatcggtaagtgaaaaataatattttacgatggagaaacaagatgtctggaaagtgcagaaagataatgtatgcacttgtagtgacagtatttgctgcttttttatggatgatctgctgtgagaatgaccggaaagtgtccgataaagctatcggcgagacaacagtacagagtatgcgttctggggaaaagacagtttcgctggagcagagtgatataccgaaaattgagattgaggatctgacagatgcatttactgtgattttacagtatgctccgaaagatatgcttgcaggctgtacggtggatgaagcatttttgatgtggttttatgcacagtatggcagggatgcagtgatacacattgcatttgatgtgctggatggcgggaatgaaccggatgtctggtatgaggaaaccggaaattctatctatgtgctgtggctgctatattgcagggacagtggatttggacagcatgaactggaaaacgtatattggatgcagacagcggctgcctcggaaatggtatttgggttcgccggtgatattaatttcgcagagaactggtatacaaccgagtatatgaaagaacagccggatgggttgcaggattgcttttcagaagatttacttgcgcagatgcagggcgtagatgtgatgatcatgaataatgaatttacctacgcaaataaaaacggggcaacatcagtttacggcaaagcttatacatttcgtgccgacccgcagaaagcagaattgttggaaatatttggaaccgacacagtgacactggcgaataatcatgtctatgattatgggaaaagaggattactttccacgttagatgtattggatcaggagggcattccttattcgggcgccggaagaaatctcaaagatgcatcgaaaattatttattatgtgatgaatggacgtaaagttgcctttgtatcggcaacacagattgagcgttccaaacagtatacaaaggctgcaaccgaaacggaaccgggtgttttgaaagcgttacatccggaaaaatttttaaaaatagtagaggaggcagcacaaaacagcgactatgtgatcgcagaagtgcactggggaacagaggggatgctttatccggatcagtcacagcggcatctggcagaacagatcgcacaggcaggagcagacgtgatcataggaggacatccacaccggctacagggcgctgcctttgtgggggatgttccaattgcatatagtcttggaaatttctggttttccaccggaacattgtatacaacactgtcaaaagttaccattacagaggatggaacagtaaaactttcttttatcccttgtatacagcagaatcttacaacaaggattcttacagaaccggaagaacgatcagatttttatgaatatctggcttctatttccgcagatatcggaattgatgtggacggggtggtttatcataaaagtgcagatgactatccggcaggagagattttatatgactctgatacaagccagacagatattatcgggatggctgataatgagggggacgcgattgatattgtcggtaacctgagagaagaccggtaatttaattttggaatagtgactgcagattctaaatctgtggtttcctatagataaatgagatatgtgtcgtacagacacctcaaagtttaagaagaagagaggataagaacatgagcaaaaaacctactgtattaatgattttagatggatacggtttaaatgacagaacagacggaaacgctgttgcacaggcaaaaacacctgtcatggatcagttaatgaaagaatatccgtttgtaaaaggaaatgccagcggtctcgctgtaggtcttccggatggacagatgggtaactctgaagttggacatatgaacatgggcgcaggaagaattgtatatcaggagctcacaagaatcacaaaagagatcaacgatggtgatttcttcaaaaatcaggctttattagacggaatggagaacgtgaagaaaaataattctgatcttcatttatatggacttctttctgatggtggtgtccacagccatatcacacatgtttatggtttactcgaactcgccaagagagagggaatcaagaatgtctatgtacactgtttcttagacggacgtgatacagcacctacttccggaaaaggatttatcgaggcactggaagcaaagatggcagaacttggtgttggtaagattgcttctatctctggacgttactatgctatggatcgtgataacagatgggatcgtgtagaaaaagcatacaatgttctcacaaaaggagagggcgagcaggcagagagtgcagttgcagcaatggacgcttcctacgcaaaagatgtgacagatgagttcttcgttccaacagccattacagagaatggaaaaccggttgctacgatcaaagataaggacacagttattttcttcaatttccgtccggaccgtgcacgtgagctcacaagagcattctgcatggatgagtttgatggtttcgagagaggcgcaagaaagaatgttgcttatatctgcttcacagaatatgacgcaaccattcctaacaaagaagttgcattcaagaaagtagaactgaaaaatacatttggcgaatatcttgcagcacacggtatgaaacaggcaagaatcgcagagacagagaaatatgctcatgtaacatttttctttaacggtggtgtagaagaaccaaacgagggagaggacagaattttagtaaaatctccaaaggttgcaacttatgatttacagccagagatgagcgcaccggaagtttgtgacaagttatgtgcagcaatccgttctgaaaaatatgatgtgatcgtcattaactttgcaaacccggatatggtcggtcatacaggaatcttagaagctgccatcaaagcagttgagacggtagatacctgtgttggaaaagcagtcgatgccatcaaagaagtaaacggacagttattcatctgcgctgaccacggtaatgcagagcagttagttgattatgagacaggagcaccatttactgctcatacaactaatccggtaccgttcattttagtaaatgctgatccatcttataaattgagagaaaacggatgcttagctgatatcattcctacactcattgaattaatgggtatggagcagccggctgagatgactggaaaatctttattggtgaaataacacccagagtttaaaggacgcagtgccgcagattttgtggtgctttcttaggatctgaagggcagctataagcgtcctttcacaagtcgtgattttatatgtaatgaaaaagaaaaacggcataaacgaaatattatgtttcgtttataccgtttttctttcatttatgttacgcatgacttgtgagaggacgctcatacatgcccggtcaacgtcatgaatcgcaccacaaaatctgcaatttacgttatggaactcccggttatagaatgaattactgctataaactagaagctaacaacatcttttcaagactataataccgccatcatcagcaatcataaaataatcgccattataactaaatccgcaaatataaagaccataactttcaaaaatttttgttttcttattttgattggaaataaaagttacagttctaatatattgcgttgtttcttgtataataatctgttctccttgatttgttacctccggaaattttccaccgtactgtcctgctattaagattgcttcactcggtaacttatcacaaaatgcaataagttcttcttcatcataatcaactatacaattttcaagctttccattatcacaatctaaaatagtagttttttgtgaagaaataataatcagtttattaggattttctttagagaagcctgtccattcaaaccctccaacagaaaaacttgttacaaatttccaatcatcaatatttttacaagcgttgatactttcatcaaaagtcattaacataaaatatcatcccatttctgcctaattgttaaggaaacaatcggagttggtgtaaacgaaaaagcagtcttgcggttttatcaaactgccctttcgtttacatcaatttcgatttttccttggtgaacaaagtcgcgtccctttcgccacttctatgggaattcaatctttgctctcttctataagtttatcatatctcgtgttttattgacagctggtttttgccaaaagaattatttttaggcatgacaaacagactccctttgcggaagttttttgaagtattcagttgtatattttaacatctcatatgcgctaaaacagatggtgtatgcttatctggaagatgtggaaccatttttccgccacaggaagaacacctgcatacatctatgttatatagcagctttatcatttcagtggcacttcgatttttcaatgcagaaatatattttttacatccaagcagatttctacagtgcgtcatctttttgctcttgtttcggcacgacagcaaaccatagtgccggattctgacaaaacgttttggtggaacatgcattaaaaatcgacggatgaattcctcgcccggaactgttttctctttccactgacctttgtttttatagtcttttacagcatatgtaacagttgcttccgtcatggacttgatccgatgattactgattgctatcctgtgagtatatttcccaagataatttatgactgactgtgctccattaaatgtttccttacaataagcaacccagtcttttttatagcactcatcgagaagtcctttgaagcaatagtggttttgatatttctccgctgtaccatgaaactcaagccttgaatcattccacaggctttttaattcgcacaaatatttcccacggaacacttttgcaatgcccccatatgggagaaaaaacttcccaccggtatctttccatttgctgtccttatcaagtccgccaccaagaacaattgtatggatatgaggatgataattcattgcagaaccccatgtatgaagaatacagatatatccgatgtcagctcccagatactttgaatctttcgccagctcgtccagagtggatgatgcagcatgatacagtgcatcatacaaaagtttctgattgctataaatgataggattcaattccacaggaactgtgaatactacatgataatagggtgcatcaagtacgttctctttttgtgcatcaatccatttctctttcggaaactcctggcacatgggacagcatctgcttctgcaggagttattatgaatgctgatacatccgcagtcctcacaaacactgatgtttacaccaaaagcgcctgttttacagttcatgatatgataagctgtttttctatgatgagcaggagggctattcctcttttcataagaaggataaaaccgttcaaatacatcttgtatcgtacatgatttctccataatcattcaccgcccatctcatcaaatggactcctgattccaagcagggttttattgcttacatgcagataaacctctgttgattttggatcacgatgtcccagaagcgcttgaatatattttacatcacagccggattcaaacagatgacttgcaaagctgtgacgtaaacaatgcgtggagacgtgtttctgaatgcctgctcttttggcactttcacgaaaaaactgaatgacactatcttttgtaagataatcccctgtccatgaacttgggaacaaaatccctcttggtctgccacattgaaaccagtattctgtcaatatctcgagcgtccggtctgcaagcaaagtataacgatcagagcgacttttcccatcacggatgtgtatagttttgttcgtgcgtgaaatatcatcataatgaagatgtgtgacttctgaaacacgaagtccgcctgaatacatagtagcaatcatagctttgtgcttcagatttggcgtagcatcaagaatagctgatatttctgtttttgtaagcaccgttggtaacttcctgtcccttttcatacgaggtatgtcatcatcatcccaattcttcttcaatatttttttgtaaaagaagcggattcctgaatggtagtgattgtatgtttccggtgaaatcccggaaagtttcttttcagttaggaatatatcaacatcgtcagttgttaatgcatctatatccttggctgtgtggttcaaaaaatgagcaacactggtacagtatgcatgaatcgtggaatccttgagattccgtttattcgcagcagatcgaatctgattaaaaatttcttcgtacataataaaatcctccatgtaaaatcagtagttaatgaaaaaaactgcttacatggaggtgcattagcataataaaaccgcttgtcagaaaagcggtcaaatggtattcttttcataggcagtggtgtctttctttattgaattgttttgtgtggtaactttacaatatcaaatactggtaagaattgccattgcctattttattattgagaaaaagaaagctgcgccacagccttggcaggccatcgcgcagcgattttgttcaacttgaatttcacgaggtgtatatttatgattattacattggaaacaagaactgctgattcggttcgaacctattttgaaaaagcaaatagacccgaaatcaagcaggtattacctcaaaaggcaaaaacagttgaagaagcattggcggactatgaggaaaccttgttgccgaatgcaacaagcttcggtcagacagtgtatgtcgatggaaagtatgtcggtgatgtttggtgctattgcattgatatggatgatgaaccaaactgtatgcttagtttctgcatttttgaattggaatattggtctaagggcattgctacatcggctgtaaatatgtttattaagaatgtttgtgagcggtacaatgtgaaaaccatcggtgcatttacctttgcacacaacaatgcttccataagagttttggaaaagaacggttttgtagttatagaagaatttgaagaagatggagttttgtcaaagtatctccagtatgagtgctgaccaattccaatttgagtaacagttaaataaacttgaattgaactaaatcgctgcgcgatggccttcgaaggctgtggcgcagttttctctttaacttaaaaaaggcagtagataatgagtcctaaaagtagtattgttaaatcaccacaaaataacaaccgaacaggatcatcattaacactgccatgaatagaataacaccagaatctttttttcacaagagggtatctttaatacgtggacctccgtgatggcagtgactcattaacgttactagtatcatggaggtttattatgtacgaaaaatattttaacaagctcagagaggaatgcctgattcgtaacaggtcctcccgaactgcagatacctatatcaacaacatacgtcactttatgaagtggacaggctataaaccaatggaagatttatcccttcaggatgccagatcatttatactggaaaaacgtaattccggtctttcatctgcaacctgcaacttttataattcttccatttgctttctatacaaacatgtcttacacatttcatgggatcaagacattgttccaagaatgcgattggatgtaaagcttccgaaagtgctttctcttgaagaaattgaaaagttaatcaattctgcaacccagatccgtaacaaagcaatcattgccctgctttattcatctggaatgcgtgtaggagaacttgtctctcttaaacctgaagatatctatatgagcactatgcaggtatatatttccaaagggaagaatcatcgtgacagatggacgattctttcagaaagagcccttgatttactaaaagaatactggagaagttatccggtaaaaagagagtatctttttgtttctttagatgctcctcatgaaccactaaaagtgagtggtgttgaaatcatgctcagggcagtaggaaaaacagcgggcattgaagcacatccgcatacgcttcgccattcctttgcaagtcacatgattgaacaaggtgtccctatcaactatgtacaggcaatgcttggacaccgctgtctggaatcaacacaggtatacatccacatatccaataaaactgttatgggaataaagagtccgcttgatcatcctgtcataaaaaaacgaggacataaatctaagagaaacgcaggtgatgcaaatgaatcatgacatcaccattcaggatgtattccatcgatttcttccgcaatactgtgagacacacaacttttctccccaacagcagctaacggcactgtgtatctccaaatgccatactcttgaaatgggagccaatttaagcgaatgcgaaaactgtcacaagaaatatattcattataattcatgcaagaaccgtcactgccccatgtgtcaaggaatggaggtcgatgaatggattgacaaacagcaggaaaatgtactggatgttccatactttcatacggtttttacagttcctgaagaattatattccctgatttattcaaatcagaaactcctttatgatgctttgtaccatgcatcacatcatacaatggcagagctgtctgcggatccgaagcatcttggagcaaggattggatatatctgcgtacttcatacctggggctccaggatgaattatcatcctcatctccacaccattgttcttggcggtggacttgatgctgcaaacaagtggaaggataaaggaaagaagtttttctttccggttaaggtcatgtctgccgtcttcaaaaagtattatctttgtgagctgaaacaactctgggaagaaaaaaaacttgagtatcatggaacagctgcacatttaaaaaatcattatgaattcaaagttttactgaattccctctaagataagaactgggttgtatatacgaaagaggcattcaatggagcggattctgtgatccggtaccttggccgttacactcatcgtatcgctatcagtaatcgtagaatcgtcagcatgacagatgagactgttacctatctcgtaaaggattacaaaaatggtggtaaatatatcgagcaaaccatcaaaggaacagagtttctgcgaatgtttctgatgcatgtgctccctaaaggttttgtccgaattcgccactatggcctgctttcctgcaggaacaagaaagaaaagatgactcactgccggaagcttctcaacagcattcaatatatttcaaaactccgaggcaaaacctgtgcggagaagctgatgatcctttacaaaaaagatatctgtaagtgtgaagcctgtggtggaaatcttctttcgctatcgcttcgaggacactacatgttgacttgagcgaagtcatttgaatactgaaaaacagccgtctgaatgaaggcttattaagtgcacccttcattcgataagacaggttactatttttgaatatatgctggaatcagtttccaatgcatagattctttggtaaaatcaagaagaaggaaatcgattgaaactccatactgtatcgtctggagtgacgcgattttgttcaatcggtaaaaatcggtgtgcagtccagagaaaagggtagctatcaatagatggtaagctgtttttttctctgtcctgacaccgattgttcacgtatcaattgatcaacttcattaatatcattattctaccataattacacttacaatcctacttcattctgttaaaatcgatttacagaagttataattaatttactttgagaatgtagattgatttttgccattccctcataggcgttcatcttataaccaagagttccataacgtaaattggcagattctgtggtgcggttcatagcgtaaattgggcatgtataagcgtcttctcacaaggcattcacagcgtaaatgaaagaaaaacggtgcagacaaatatgatttccttcgtgagccatggagctggggttctaaaaattttgtgaagcctctgtttcacaaaatttttgctcagaagcccagcggaatgcccggcgaacaggaacatcatatttcgtctgtaccgtttttctttttcattacatataaaatcacgacttgtgagaggacacttatacatgccccttcagcccctgagaaagcaccacaaaatctgcgacactacgctaatgaaacgatggatacttatcttatatctgtcaaattagaacaggtaaatacatatataagcgacactaataatcagatataaaatgcacaaaaatacttataaaaagcggtggattttctatatgtgcaaaagggcaaagaacaggtaaacacattgactttgcaaaagcgtgtgtattagaatagtggtataatattgctttgcaaaaacaaggaggcgaaatcctctcctcgtataggactcggatttttgctccgcaaaaacaaggaggataaatcaatgcaggaatttaaaccagtaaaagaaggaaaagtacgtgaggtctatgataacggagacagtctgatcattgtagcgaccgacagaatttcagcatttgaccatattttaaaaaataagatcacaaaaaaaggtgcaatcttaacacagatgtccaagttctggttcgactatacaaaagatatcgttccaaaccatatgatttctgtagatgtgaaagatatgcctgaatttttccagaatgaaaaatacgatggaaacagcatgatgtgcaagaaactgaacatgcttccaatcgagtgtatcgttcgtggttacatcacaggaagcggctgggcaagctacaaagaaaatggtacagtctgtggaatcaaacttccggaaggtctggtggaatccgataaattaccggaaccgatttatactcctagtacaaaggcagatcttggggatcatgatgagaatatttcctttgagcagagtgtggaagtgttagagaaacttcatccgggaaaaggtgaggaatatgcaaccaaaattaaagacgcaaccatcgccctttacaaaaaatgtgcagaatatgctttgagcaaaggaatcattattgcagatacaaaatttgagtttggtttggacgagaatggaaatgttgttctcggtgatgaaatgttgactccggacagctccagattctggcctttagagggatatgaagcaggaaaaggacagccatcctttgacaagcagtatgtgagagactggttaaaagcaaaccctgacaatgatttccttttaccggaagaggtagtaacaaagaccgttgataaatacaaagaagcatttgcattattaaccggtaaagaatttaaataaaatgccaaagggcatagatggagttacactgacctggattttcaggaaaccagcggaaaggcagaaacgattatatgtataacaacgagtttgaaaaagatacaccatgggatgatctgcatgaggaatgtggtgtctttggaatgtatgattttgatggaggagatgtagcgtctaccatttattatggactgtttgcattgcagcacagaggacaggaaagctgcggtatcgcagtcagcgagacagatggtcctaagggaaaagtgacttcccataaaggaatgggacttgtaaatgaagtgtttgcccaggataatttagaaccgatgaagggagatatcggagtcggacatgtgcgttattccacagcgggtgcatccacccgtgaaaatgcacagccattggttttgaattatgtaaaaggtacgctggcgctggcacataacggtaatctcatcaatgcaatggagcttcgcaaagatttggaatataccggagcaattttccagacgaccattgactcggaggtgatcgcatatcatatcgcaagagaacgtctgaaatccaagacagttgaggaggctgttggaagagcctgccgtaaattaaaaggagcgtattcgctggttgtcatgagcccgcggaaactcatcggtgcaagagatccttttggttttaaaccgctctgcattggaaaacgtgataatgcttacattcttgcgtctgagagctgtgcattggagacgatcggagcagatttcgtgcgtgatgtcctgccgggggaggttgtgaccattacaccggaaaacggaatccagtccgatttgtcgatggcattaccaaaagagcaggaagcaagatgtatttttgaatatatttactttgcaagaccggacagccgtatcgacaatgtgagcgtctatgcatcaagaatcaaggcgggacggtttcttgcgatggattcggctgtggacgccgaccttgttgtcggtgtgccggaatcaggaaatgcagcggcattgggctattcattacagtctggaattccatacggaacagcttttgtaaaaaatggttatgtaggacgaaccttcatcaaaccaaaacagagcagccgtgaatcgagtgttcgtgtgaaactgaatgttttaaaagaagccgtaaatggaaaacgcatcatcatgatcgatgattctatcgtgcgtggtacaacatcggaccggatcgtaaaaatgcttcgtgatgcaggagcaacagaagtgcatgtaagaatcagttccccaccatttttgtggccatgttattttggaaccgatatcccggagagagagcagctgatcgcttataaccggagcattgaagaaatccgtgatattatcggagcggatacgctcggatatttgaaggtggagcgtttacatgagatggtggaaggcttaaatatctgcgagggatgttttacaggaaaatatccattggagccaccgaaagaggacattcgtggtgacttcgaacgctaagtgtggtatgatgaaatagattacaatttacagcaaaaggagataaaaatgagtacagatagatatacaagccctctgtcagaacgttatgccagtaaggagatgcagtacattttttcacaggatatgaagtttaagacctggagaagattatggatcgcattggctgagacagagatggaacttggcttaagtgagaatggtaaaccggttatcacacaggagcagattgatgagttgaaggcgcatgccgacgacattaattatgatgttgcaagagagcgtgaaaaattagtccgccatgatgtgatgagccatgtatatgcttacggacagcagtgcccaaaggcagcaggaatcatccatctcggtgcaacttcctgttatgtcggcgacaatacagatattatcgttatgaatgaggcgttaaaactggttcataaaaaacttgtcaacgtgatcaacgagcttgcaaagtttgcagataaatataaaaatctcccaacgcttgcatttacacatttccagccggcacagccgacgacggttggaaagagggcaacactctggacacaggaatttatcatggatctggaagaccttgagtatgtcatgggaagtttaaagttacttggttccaagggaacaaccggaacacaggcaagttttctggagttgtttaatggtgaccaggaaacaatagacaagatcgatcctacgatcgctgcaaaaatgggatttaaggagtgttatgcagtttccggtcagacttattccagaaaagtggatacaagagttgccaatattctggctggaattgcagcaagtgcgcacaaaatgtcaaacgacatccgtctgttacagcatttaaaggaagtggaagaaccatttgagaagaatcagattggatcttcagccatggcatataagagaaatccaatgcgttccgagcgtatcgcatctctttcacgctatgtgatggtagatgcattgaatccggctatcacatctgcaacccagtggtttgagagaacgcttgatgattctgctaataagagattgagcattccggaaggatttttagcaatcgatggtattttagatctgtgcctgaatgtcgtggatggacttgtggtatatgataaagtgatcacaaaacatatgatggcagaacttccatttatggcaacggaaaatattatgatggatgctgtaaaaaatggcggcaaccgtcaggaattacatgaaaaaatccgtcagctttcgatggaagcaggaaagaatgtaaaggtagaaggaaaagataacaatctgttggagttgatcgcagcagatccatctttcaatcttaccttagaggaattacaggctactatggagccttcgaaatacgttggacgtgcaccaatccaggtggacaaattccttgcaaatgttgtgaatccaattttggaggcaaacaaagaagatcttggcatgacagccgagattaatgtataaaaccggagtttcacttatgaactgccgcttgcaggtggtggcacggatttttagattgaattttataatttaggttatgaacaaaatattgcagtctgacatgtttatgaaaacatgaatgtgaaatggacgaatattgtgtttcgttgcgttaaacattgcgatgaacctctctgaacatttgtgttcagcagaggcttccacaaatggagagtttcatctccataacgcaaaacgaaaacaatattcgtccattttacattcattatctcataagttatgaaactgcaatattttgaatatacactccatagaaattcaatctaaaaatccgttaatccatgttatgagcggcagtaaacaaaccttaaactccgggaggagtgcccttatcatcgataaatcacaaggcattgaaaatgactgcatttagccgtttcctcctttatgggcactcatcccataaccggagttcataacgtaaattgcagatcttgtggtgcaattcatgacgttgatcgggcatgtataagcgtcctctcacaagtcattcataacgtaaatgaaagaaaaacggtgcagacaaatatgatttccttcgtgagccatggagctgggattctaacaatcatggaagcttcagctgaacatgattgttagaatcccagcggaatgcccggcgaacaggaacatcatatttcgtctgtaccgtttttcttttcataaacttataaaattaagacttgtgaaaggacgcttatatctgcccttcacaacctataaaagcaccacagaatctgcgacactacgtccgttaaactctgggtgagtgcctatgagataacggcaaaatgcagtcgttcacgatgacttggcggtcacaggatatattccatctgccgttcctttgtcttcatccccattttttcgtagaagtgttctgccgaagtgtttcctgcccagacgttcagtgttacctcatagcagccctgctcttttgcctgctgcttcacatattcaaacaggctttctccgatgtgctgtccccgtgcctgctgatcaacgcacaaatcgtcgatgaatagcgacttaaagggaatcatgttcgtggaaaatggctgctccttcatctgacagaaggcgtagcccatacacacatcatcctcgttcacggcaacgtagataggtttatcctcctgcttcaaaagctctgcaagttcgcagacagtgtatttggtggtgccgggaataaaaatatccggacggatctctgcgtggatctgcaatacctgctccaacagtgcaagaagtctgggaatatcttttgcctctgccttacggattttcatttcaacttcactcctttacaattctgattcgcaaaattcattgatattgtaattctatcatagtcatactttttattctactaaaatacattgaaagaagttttactttgtaagaaccttcttacaatatttatgtgcaccacaatgcggacattctgtattctaattagaaagaagtggaattgcagatgcgattatgttagaatcttagtgttaatgaatgtagcaatatgatataatgtgcgtaagcaatgagcagtgccaatcgagaatatacagaccggacatgcttgcatggtgaggtctgtatatatcgagagtgatagggcgaatgcccgtcagccagaaaaatctttgatttttctggcatgcactgcggactaagcttcatgatataatgttcatgtattcaaacaaagtaggagagaggtaaatacaccatgaatttgaaaaaagttcatcacattgccattattgggagcaactatgagcaatcaaagcacttttatgtggatctgttaggattttctattattcgggaaaattacagaccagaacgtgatgattacaaaattgatcttcaactcgatgggatagaattagaactttttatcattaaaaattgtccaaagcgcctcagttatccagaggcttacggtctccggcatcttgcctttgctgtagactcggtcgagaataccgtaagagaattgaataaaaagggcattataactgagccgatcagattcgatatttacacaggcaaaaaaatgacattcttttatgaccctgacaatctaccattggaaattcacgaataaagcagtacttttctttttcacagagctgtttgtatatggtttctgcgtctatgttataatacttctgttatgtgaatttataatctgattcgcaaaggagaaacgtatggacgtatcatataacaaattttacaagatgctgattgaccgtaaaatgaagaaaaaagacatttgcgagcaggctggtatagctaccagtaccatggcaaaaatggcgaaggacgagaatgaacaataatttataccatgaaaagtatgacgggagcaatgaagcagaggtgttccgtcatgaggtgatcatggacctggttttttgataaaaaacaatcagagccttgcatccggatctgtcgaaaatccacttgcggattagcctgcatgtgggtaaaatgtaactattcggagaaggctcacacacattgtgcagaccgtaaaaatcaacagtaagatacaaaagaagcagggatcaatatggaaaaagatatcaacacggaagtttcaaatacacagttaccggcaacggaagaaaaagcgaatctcaaagagagtctgcgcattcagaaatcccagtggatcaaggaacagatcaaaaggcagcgggaagcggaagatgctgttttagagcagatgatcgaagaacagagagtcatcgatggtttaaacagcgacatcaatgagaatctggacaggacaagagagagccggaagtttaatcaggagtttcaggagaagatcaatactcagatttacgagatgaacggcattacagaggataaactgaaaggtatgcgcgaatacaaaaacgcatactatcagggatgtgcattttccctgtttctgctgtctgttgttatgattgggatctgtggtgtgcttcatggttttgagtcacagatttgtctgtttatgatcgcatgcaccggcgtagagggggcactgcttgcacaggacaaatggagaaataaactggtaaatatattatgtaaactgctttatctgatggtttttccggtaatgatggttatttttgtctgctacgaactgaaatatccggaatatgaccttttcctgccatattttgcaatgggaatcgtggttgtcctgatcattggaacggcggcatttttcttttatgatccgtataagcaggataaaaagcgtgtgaaaaatgcaaaagattatatttcagaagtggaaaagattgcaaaaaaacaggtgaagaaaaatcagaagctccgcgcaaaagaggagaaaaagaatcagaagatccagctgcgcactctggaaagagaagaggctgcaagggaaaaagaagaaaagctgcaaagtaaaaaggcagaaaaggaagccagaaagcaggagcgcagggaaaaaagacaggcgtggcttgctggtgtaaaagaaaaatggcatgcctgggtggaaaaaataaaagaaaagtggcatgcgtttcttgcaaagtttaaaaaggaagaatagaaatgagatatcagatacggcatgcaattgtaaagtatgcggcagataccatattagaagatgtaaattttgagatacatgatcatgaaaaaatagcaatcatcggaagaaatggctgtggaaaaacaacgcttttaaagctgatctccggtgaagtggagatggcaaatccggacagtgacgaggaatgcggcattgtcatggcaggaaaacagcagatcggctatctgagacagatcagttttgaggacagcagtatcacggtagaagaggaaatcttaaaagtgtttgcgcctgttttttcctgcgaaaaacgaatgcaggaactgacagagcaaatgaaaacggatacttctgagcatttattaaaggaatatgccacattgcaggcgaagatggaggcactgcggggatacacctacagacaggatatggagacaatgttccaacggttcgggtttgcgttaaaagacctgcaaagaccgattggaactttttcaggtggtcagcagacaaaagtggcgttcgtaaaactgcttttgagccagccggatatcatgcttttggatgagccgaccaaccatctggacatgccaacgatcgagtggctggaaggttatctgaaaaattatccgaaagcggttgtgatcgtgtcgcatgaccggatgtttttagaccgcgtgattgacgtgacttacgagatcgaatatcacagaatcaggcgttatccgggcaattatacagcatttttgaggcagaaagaggaagcattagcaaagcaggaaaaagattacgaggcacagcaggcggagatcaagcgtctcacagactggatcgaaaagtggaagaatacaccgacaaaggttgcggcgacacgttctaaacgaaaagtgatcgagcatatgattttgatcgaaaagccgcgcaagttcgatacaaaagcgtttcagggacagtttctgccgcagacggccagctatcatgatgtgttgtccgtccggggcttacagatcggttatgattccgttttgagcaaagtatcttttgagctgcaccgcatggagcggatcgcggtgatcggtgaaaacggaaaaggaaagtcgacacttttaaaaacgttagttggggagctgccgaagctcggcggtcagttttcattcgggacaggcgtggagtggggatattttgaccagcaggcggcggttgccgagagtcagaatccgaaaatgacgatcatggaagatttctgggaagaatatccgaccttaaaagaagtagaagtgcgcagtgcgctgggaagttttcttttttccggggatgatgtatacaaagaattgggacagctatccggtggagagaaggtgcgtcttgctttatgtaaaatgtttaagcgcagaccgaatcttctgattctggacgagccgacaaaccatatggatatcgttggaaaagaagcattggagcagatgttaaaaagtcatacgggaacagttttatttgtctcgcatgaccggtattttattaaggagatcgcaacgggaatccttgattttcaggcaggtaaagtacagtattatccgtgcacttatgaggaatatctggagcagaagcagaaagaagcacagggactgattggtggaaacaaaacaaatgccgcaggaaacagtggaaaatccagaaacgtagctggcgaagcagcagataacagaaatatatcacaagtcggaagtcagagtaatccgccaacgttatccgatgtgtttgataaaaagacgtattataatccgggcaagattatttccagattaaagcagcagcttgtcaagtatgaaaaaatgctcggtgagagtgaggaacggctcgcagagctgcaaatgcagcagatggacacggcactcgccacggactatgagaaattgacagaattggagcaggcgattgcggcggagcagagcaatcaggagagcattttagaccgtctggtggagacggagacagaactggatgagatgcaggagaaaacagtctaaacaggatcagactttgcaatacaagaaaaaacagtagatttggaaggcagaaaatcgaggaagcagatatgacaaaaaaacagttagcacttgagattatcaaacgtttgaaagaagcgtatccggacgcgggatgtacgttggactatgatgaggcatggaaacttttagtgagtgtccgtctggctgcgcagtgtacggatgcgagagtcaatgtgatcgtggaaaagttatatgagaagttcccggatgtcgacgcattagcggcagccggtgtctctgagatagaggagattgtgcgtccatgcggacttggaaaaagtaaggcaaaagatatcagtgcatgcatgaaaatgctaaaagagcagtacggtggaaaagtgccggatgattttgatgcactgttgaaacttccgggggtcggacgcaaaagtgcgaatctgatcatgggggatgtgttcggaaaaccggcgatcgtcacagacacacactgtatccgtctggtgaaccgcatgggactggtaaaagacatcaaggaaccgaaaaaagtagagatggaactgtggaagatcattccaccggaagaggggaatgatttctgtcacagattggtggagcatggcagggatgtctgtacagcacggacaaatccgcattgtgaccgctgtgtgttaaatgatatctgcgcgacagggaagaaactcatgaaagcagagcagaaaacaaagtgatcgatattggtgttgcagtggcagcagtaaaaaattttaaagagaagttataaaaatggcagtacaaaatgatttttcgaagggaagtattttatcccatatggcacggattgcgcttccgatgacgctggcacagtttgtcaatattttatataacattattgaccgggtatttatcggacgtatcccggatcatgcgacggaggctttgaccggacttggagtggcattcccaatctgcacactggcaattgcttttgccaatctggtaggaatgggcggtgctcctcttttttctatagagaggggaaaaggaaatgaagaggaagcaaagtatattttaggcaattcattcaacctgttagttgtcattggagtagtgttcagtgtggtgatgtttctggtaaaaaggccgatgctatacctgcttggtgcaagcaaaaatatttacggatatgcggattcttatctcacaatctacttatgcggaacactttttgtgatgttaagccttggtatgaatgcatttatcaatgcgcagggctttgccaatatcggaatgatgacggtatcgatcggtgcagtctgcaacctgattttggatccaatttttatttttgaaatgaaaatgggtgtacagggagcagcgctggcaacggtgatctcgcagtttgcagctgcctgctggacactccggttccttaccgggaaaaaggcgacgatccggttagataaaaattatttgaaattaaaaacagaccgcgtcaaaaagattcttgtgctcggtttatccggttttactatgtcggtgacgaacagcctcgtgcagatggtatgcaatatcaatctggcgatgtacggtggagatatgtatatcgcagcgatgactatcatcaattctgtgcgtgaagtgatccatatgccggtttccggtgttggaaatggggcacagccggtcatgagttttaattatggtgcgaaagaatatgggagagtgaaacagacaatccgctatacggcggtcattcttctggtttatacattatttgcgtggggaatgacgatgttatttccgaaccagtttgtgatgatctttaataaagatgcagagttgctgccacttacggtaaaatccatgcatatctatttcttcggatttttcttcatggcatttcaattcaccgggcagacaacgtttcaggcacttggaaaatcaaagcaggcaatcttcttttccatgttaaggaaggtgatcattgttgtgccgcttacgtttttactgccaatgatcccagaaatcggcgtgacaggcgtatttcttgcagaaccgatttcaaacctgatagggggactggcctgctttattaccatgtatgttacggtttaccggaaactggaggtttgacaatttacgctgtgaatcgcaccacagaatctgcactttacgttatgggatgagtacctacagggtaacatcaaaactcaacctgcatcctcgaaataaatcaattacaaattctttaaatgattttttacagagccaaataggattgcaggtatgattaattttaacaaagcggaattgaccgagctgaaagtgaggattttttatgaacataaaatatgatcagctatgtattagaaatgcagagaaaaaggactgtgagcaattagcaaaatggtggaatgacggaaaagtaatggcacatgcaggatttcctaatggacttgggacaactgcaaccgaaatagaaaaacaaattgtgaatgatagtgatgagaccagaaggcgattaatgatagtatataaaaatacgttaatcggagaaatgagtttttacgtgtatgaaaatgcaaaatatgagattggaataaagatatgtgagtttgattatcaggaaaaaggacttggaaagattgtgttaagtatgttgattgaagaactattccatatgggtgcacaacttatctttttggatacaaatctgaataatatcagagcacagcatgtatatgagaaattgggctttaaaagaattgcaattcattgtgattcatggaaaaaccagctgggagagttacagtcaacggttgattatgaactgaccaaaggtgatttttgtaattttaagaacagataacttccgatacgtaaatcgcagattctgtggtgcagttcacagcgttgatcgggcatgtataagcgtcctcccacaagtcgtgattttttataggtttatgaaaagaaaaacggtacagacgaaatatgatgttcctgttcgccggacatttcgctgggcttctgagcaaaaattttgtgaagcagagcttcaccaaatttttagaatcccagctccatggctcacaaaggaaatcatatttgtctgtaccgtttttctttcatttacgttgtgtgtccagcgaagctggaccacactagccggtgtaagtccggtcacggtaatcgccagtgagccgtgtagctaaactcggtgcgttgcagtaatgcagggtactaagcgagtggataaagtaacctcggtaagaggggcgagcaattatgcagaccgtaacataaagtgaattctgccgtatcgttagaaaggtctctgaaaagagagcaaagggaagctgaaccctgggcgtatgggtgaaagccatggaacgtgtgaagaaactggaaagcagcacggaggaatccctcggtatataggaaacggtatgtatgaaaagtgtggttcggaactggagagaccctacccatcaccgaaaggtaaaaagaaagcgtataagcttggcgaaatcgtatttctgatgggagggagtcggagaggaacatagtaccgataatgactgtgcaagaaaacgcagtctatgggaaggttccttgcttcattcatgtttgtagagagggtaagagtgagagaatgtcatgcagactaataactccaaagaaaaagttcgacaacttcaaaacaaactatatctgacagccaagaaatgtgatagccgaagatttcatgcactttacgataaggtatatcgtgatgatgtactttttgaagcatggaaacgggtaaaagctaacaaaggttccagtggtgtagatggtatcggaatcgaagatattgaagagatgggaattgaaaaatacctgtcagaaatcaaatcggaactgatggatggaaagtataaaccatccccagtaaagcgagttatgataccaaaaccagacggaagtgaaagacctcttggaataccaacagtcaaggacagaattgtgcagatggctaccaagatagcaatagagccagtattcgaagctgactttagagattgttcctatggattccgaccgaaaagaagtgccaggcaagcactggaagtggtaaggaaagcgtgtaacaacaagggctattatgtagtagacgcagatattgagaagttctttgataacgtaaaccaagataaactgatgaaactggcagagcagagaatatcagaccgtaggatattgaagctgataagacaatggttagtatcaggagtattatacggaaatgtactgacaatttccgaactgggaacaagccaaggttcagttatatctccgttattggcaaacatctacttaaatacactggacagactgtgggaaaagtatggacttactcacggtattcttgtaaggtacgcagatgatacagtcatcatctgcaagaataagaaaaatgcaaatcacgcactgaacttattgcagtacatcatggcaaaactggatttaaagctacacccagtaaaaacaaagattgtcagcatgtgggacggaaaagagggatttgactttcttggaatgcaccacagaagaatgacaacggaaacaagcaaaggacaattgtataaagaaacttatcagtacccgagcaggaaagccatgaagaagatgaaagcagaaatcaaaaagaatgtaaacggtcgaagtctgttagttgcaaaggaagaggatttaataaagaatctaaatccgaaaatcataggttggaagaattattattccaccaaaacaaatgagacatggatgcaggaattagactggtatattatctgcacctttacaagatggtataacaagaaacaccaaaggtgtaaacatatgtcaagagtgggatttgttagaaatagcatttacgaaaaaggattaaagaaaatggctagagcatgacgtaatgctgtagaaagaagaatgtcggaaagccgtgtgagggagaacctcatgcacggtttgatgaggggcggatgaaattttcatccgcctactctacatgaatgacttgtgagcggaagcttatacatgcccaatttacgctgtgaatcgcaccacagaatctgcaatttacgttatggaactcacggttatgggatgtctataaaagaggtaggataagctgcttggacttcatgaatattgtttctacaataatcacaatcacataaatcttcatttcttatttgattgtaatatgatttgattttctcaatatccaaagggcgtgtgaaaaaacgagagttttttcattcgtccttttgcttatagttataataatagctatattacataaaaaagggtatagttccccttaccccataagaatgatattatgaaatcttatgcggcagctgcaacttttttctgtttgttgtgatatttataaagattgtgtccgatagaaacgagaaatacttcaagcaatacagattttattcctcttcggacaattcttttgtaccaccggtcgtttttcatgataccaaaggtaccttctgcctgaatggatctgttcatccttagaagcgctccctggatgctttcgagattttctatcacttcctgatgcatcgctgtaagttcgcggttgatccgtacagtacggtttttatctgtctttttacattgttctgcatatggacagccggagcaatcttcacactgatacacttcttcctgacgcccatacttgttcccttttacgttttttcgatactgaagataaaagcttttcccatttggacaacgcatgattccgccttccccgattggaaaatttactgcacgaaatggatcttcatgatacttcttgtctgtagtctctttcttgaacatggtaaatttcatatatttttccattccatgctgcccacagaagatgtaattgttgtaagaaccatatccagcatctgctactgggtacttcggataaaagccatatgtagtataaaacttgttcattaatggaataaaacaatccatatctgagcgatactgatttacatcaacaacagcaatatattcatctgcaataccgacctgtacattataagctggaagcaactggtcattgcccatgtagtctgtcttgattcgcataaaagtggctgaatggtctgttttcgagtaactgttgcgatcttctccacagattttgattttttccacgtattcttccaacttagcagcatactctttgagtttctcataatgacgttgttgtgtagttttgcgatgtcccctgccatgaacaaacattgcttcattaatctgccagacttctgcatactgttcagcagcttccttcagatactctggtgcgtactcactattgatacaaagtttcatacctgtacatgaaagttcctcattgatttcctcaaagagtgtagttaccttaccaaagagacggtatctggatttttcggttgcttttttccatacccaggagtatttattcgcatttgcttcaaacttggatccatcaatgtatagatgttgaagatctacatgctctgtctcgaagatttttttgtttatatcttgaaatatttcttcaatggaatcagcaagtacttcgttgatgaagtagccgaaagtacggtaagaaggtgcttgatgatccataagatacatgaagcggagattgactttacactgatcctccagttcacgcaatgatatatagccattcgccataaatccaaacaaaactgttttcagcatgctgaccgggtcatatctgagtcttcctgtataatgttgaggaatatttttcagatatttctccagttcgatttctcccataaatctatcaaaagtcagcactggatcacagatgtccaaataatcttgaattagcattggcaaaactgcctgttttgggttagaatagattatgttattaatttttttcacaaattaattataacagaaagaaagaccttgagttcattataaactcttggtctttctttttttcgggactattcttttttcacagcccctttagataatgacctgaatccgtgaagttaatttcttcacagaccccttaaatcctataatttcaagcctttgcgatactttgttgttcaatatcattattcacccactcggtgaaagaaatctatggtaaaatagatattgcaaaacctatggattggagtcttttaccatgaataacaaccaccgaatcacactgaacaccaataagaacattattgttgaatttacaaacgaacgcattattcccgccagcggcctggctgttgtaggtgccctcctcggaaaaagcggtttcattaaaaaacttaatcgcatggatgtaacatccaatcgatcccagcatcagattaagaacggtgatattgtactcacttatcttggaatgctttgcatgggcaagccttactttgaagctgtccatgaaatggacgatgacaaggacttttacaaaaccgctcttgccaatggtcttgttccggtagatatcgatgtgacacctatggataattcgaaatccaaaaaggaaggtgtttcacgaacctacaaagggtttgacgtctatgcgcctatgatggcatatataggtacagaggggtacgccatcaatttcgaactccgtgaaggaaaacagcattgtcagaaggggacggttgagtttctgcaggaaacaataaagctttgtcacaaactgacagataagccgctgttgattcgccttgattccggcaatgactccatcgacaacgttgctgttctgatggatacaggctgctttttcattatcaagcgaaaccttcgccgggaaagcacggatgattggtttgaaatggcaaagcagtacttccagaatgtaaacagtcccagagatggaaaaacggtttatataggcagtgactggaaaaccgttaccagtaagcagttcaataaagagtttacactccgtaccggctacgagattacggaacgaaccattgataaatatggtcagttcaatcttgttcctgatgttgaagttgaaacatggtggacgaaccttggtgacccggatgaggaaatcatccgtctgtatcatgcccatggagaatgtgagcagtttcatagtgaggtaaaaactgacatggatctggagcggcttccatccggaaagtttgcgaccaatgcactgatactcgaattggggatgatcgcatataacattctccgtatgatcggtcagggcacaattggagaacgggcaccccgtcaaaagaggaatgttaaacgccgtcgtttacgcacagttatcagcaacctgatcatgctggcaggccatgtaaccatgcatgcacgccagttgataatcggccttggaaaaagcaacgtctggcggcatatattttctgatatctgtcagaaatatgctgtcacaaacgcataagtaacaaagcaaatttatagcaggcttatttcgtgtacccttttttgcccaatgagcgcttggagtcacgacattggtactgaaaatagacattgaagtatgtttttatcatgaaaccaacttgcccttggcaggttggttcgcttaaaggatgaacttcacggattcaggtatgatattgaatataattaccatgagtactctgacgagaaagtctatattactttgggatttaatattggggttgcgaccaaatacttctatataaacaataaaaacgcatataccaataacctcgcatttgctaatgtttttgcaaattatgtgagactgctgtttgaggcggagcttgcgttaaatgttgattggcagatacattagacgatttaaagagaaatttgcagagcttggctaatagtatttctagtaagttgaatgaacggcaggggtatttggacaaggcagatgaaatccaaaaggtatacgatagacttgcacgagacaaaaagacaatcaaagaatatcggaatgatattgtttatttttataaggagtcttataatgagtttaagggagataactataagtatacttataagccttcgatacaggatttaagggattcatatgatgatgtgatttcaaacattgatataaatttagatgcacttaataatcagatattgtcctacaaaaataaggcgtcagggtgtttgggatctttgggctatatgcagatagcatataattctgttaaaacacagattcaaaattggactaattaaaggtgatttgtatgggaaagattaatgtaaaaattgctcaggcacatgagaaccaaatgagaaacttcgatgtgcaaagagaaatgaaaagtgtccaaaattattttgacacaaccgaacttgatttcaattctgaagcagtctcgctgatgtttttgcgtggacagtataatgattttgcatagacaatgaatacagcactggtttttgttaataaaatgggacagaaaattagtgaattgcatggagtgattcatattcacaccaatacagaaggcattcagtttgcaaaaacaacaatagacttcgatgaagaattcatgggagtattatgtgataatgagggcttattggttcatttgaatattccggtgagaggtttggaaggaaacagaacatttacagaaaaagagttggaggtgcagttcgcagatgtgcgcgtgacttatgcgaacaagtagtgtaatatgaaacagatattagaaaaatatttagcaataacgctggtgttggtgctcatgacaggttgtgggagtgcggctgacaaagaaattatgacagcaaaagagtttcagaaaaaaatggaagggatgggactgactgtagaggatcagacatcttctgccaaagattcaacttatcagaagatatatgttgcggtggatgaagaaaaatattcatttgaatattattttatgaaaggtgaggattctgcggatgtagtctatcagtatgcggtttcaaacctgagcaatacgtacgacggtgttgatgatgcgacaatattagaagatgagaataactcggttgcggattatagcataagcgcatccgattattattgtgaagtcttgaaaaaagaaaatacagtattatatgtgacagcatatcatgattatgaattagaggcaaaaaaaattattgatgagttagggtattaatatgtttgggtttattaagaggaaatgtactgcagaaacacttggaacaatagtaaagaagagatggaatggtaatttatggtttataacagttgagtatttcgtggaaggacaatcatatatcgtcaaagagcagctcacttataaggttgaaaaaaaatataaagttggaaaggttccagttggaatgcattctacatcggcactgaagagtattgatattaatgccagtgtccgtgttaagtacaatccgaataaacctaagcagagctatttgccggataataatggacttcatttgggatagagatggtgtttgataatgaatgggttatagattattcggcttcaaaaaaaaatcacatctctcatagatgcagttaataatagcgttgacaattatggaaaactggcagagcggatagcaccataatgataagtattattgctgttgtgaagattttaaggatgacaacagagatagatatgttgtttacctgaatccgtgaagttcatcctttaaacgaaccaacctgccaagggcaagttggtttcctgataaaaacatacttcaatgtctattttcagtaccaatgtcgtgactccaagcgctcattgggcaaaaaagggtacacgaaataagcctgctataaatttgctttgttacttatgcgtttgtgacagcatatttctgacagatatcagaaaatatatgccgccagacgttgctttttccaaggccgattatcaactggcgtgcatgcatggttacatagcctgccagcatgatcaggttgctgataactgtgcgtaaacgacggcgtttaacatccctcttctgacggggtgcccgtcctcctattgtgccctgaccgatcatacggagaatgttatatgcgatcatccccaattcgagtatcagtgcattggtcgcaaactttccggatggaagccgctccagatccatgtcagtttttacctcactatgaaactgctcacattctccatgggcatgatacagacggatgatttcctcatccgggtcaccaaggttcgtccaccatgtttcaacttcaacatcaggaacaagattgaactgaccatatttatcaatggttcgttccgtaatctcgtagccggtacggagtgtaaactctttattgaactgcttactggtaacggttttccagtcactgcctatataaaccgtttttccatctctgggactgtttacattctggaagtactgctttgccatttcaaaccaatcatccgtgctttcccggcgaaggtttcgcttgataatgaaaaagcagcctgtatccatcagaacagcaacgttgtcgatggagtcattgccggaatcaaggcgaatcaacagcggcttatctgtcagtttgtgacaaagctttattgtttcctgcagaaactcaaccgtccccttctgacaatgctgttttccttcacggagttcgaaattgatggcgtacccctctgtacctatatatgccatcataggcgcatagacgtcaaaccctttgtaggttcgtgaaacaccttcctttttggatttcgaattatccataggtgtcacatcgatatctaccggaacaagaccattggcaagagcggttttgtaaaagtccttgtcatcgtccatttcatggacagcttcaaagtaaggcttgcccatgcaaagcattccaagataagtgagtacaatatcaccgttcttaatctgatgctgggatcgattggatgttatatccatgcgattaagctttttaatgaaaccgctttttccgaggagggcacctacaacagccaggccgctggcgggaataatgcgttcgtttgtaaattcaacaataatgttcttattggtgttcagtgtgattcggtggttgttattcatggtaaaagactccaatccataggttttgcaatatctattttaccatagatttctttcaccgggtgggtgaataatgatattgaacaacaaagtatcgcaaaggcttgaaattataggatttaaggggtctgtgaagaaatcaacttcacggattcaggtaatgagaaagccgtttgaaactatgtcacttgaatttgactgcattttgtcgccacatttctttataggcactcatccaataaccggagttccacaacgtaaatcgcagactttgtggtgcaatttacagcgttgatcgggcatgtataagcgtcctcccacaaggcattcacagtgtaaagaaaaagaaaaatcgtgcaaacaaatattattttcttcgtgagctatggagataagactctttagaggcttatcggaatgtccagcgaacagaaacataatatttcgtttgtacgatttttctttataatcaacatatatgatatgccttgtgagagggcgcttatatctgccccttcacaagctataaaagcaccacaaaatctgcgacactacgttcatgaaaatttactcagccagatttcccgtataaagctgatagtattttccatgttcttccatcaactgctcatggctgccgcgttcaatgatgcgcccctgctctaagaccatgatacagtcactgttgcggacagtggagagacggtgtgcgatgacaaaagtcgtacgtccgcgcatcagtttatccataccatcctgtacgatcttttccgttctggtatcgatggaggaggttgcctcatcaaggatcagaacaggaggatcggcaatggcggcacgggcgattgcaagcagctggcgctgtccctgacttaagtttgcgccgtctccggtcagcaatgtgttgtagccatccggaagctgatggatgaaggtgtctgcatttgcaagttttgcagcagcgatgacttcttcgtctgtcgcatccagttttccgtaacggatattttccattacagttgcggtaaatagatgggtatcctgcaatacgattccaagggaatgacgcaggtcgtcttttttgatcttattaatgttaatgccgtcgtagcggatcttgccatcctgaatatcgtagaaccggttgatcaggtttgtgatcgttgtttttccggcaccggtacttccaacgaaagcgatcttctgtccgggagtggcaaaaaggtctacgttgtgcagaaccattttgtcaggattatatccaaaatcgacatcatcaaataccacatcaccctttaactcaatgtagtcgacagaaccgtctgcctgatgcacatgcttccaagcccacattccggtacgctcgctgcactctgtaatctggccattttcctttttcgcacgcactaaagtcacgtatccatcgtccgtttccggtttttcatccagcagattgaagattcgctcggaacctgcaagcgccatgacgatattgttgatctgcatgcttaactggttgatcggctggctgaagctcttattgaatgtgaggaagcttgccagtttaccgagggtaaaaccgcctataccttccagggcgaggatgccgccgactaaggcgaccagaacataacttacatttccaagctgtgcattgatcggcattaagatattaccaaatttgtttgcgttatcagcactttcaaataactggtcattcagcttgttgaagtctgcaatactttcttcctcatgggtaaagacctttactaccttctggccattcatcatctcttcaatataaccgttgaccgtggcgatatcacgctgttgggcgataaagtacttggcactggcaccacctaccactttggtggcatagagcatgactccaaccataaaaagtgtgatgatcgtcagtggaatgtttaaaacgatcatggcgccaaggacactgacaatcgtaaccgcactgtttaaaacctgcgggatactctgactgatcatctggcgcagggtatcaatatcgttcgtataggttgacataatatcaccatgtgggtgagtgtcaaagtaacggatcgggagtccttccatatggatgaacatatcgtttcttaagttccggagtgttccctgtgtgacgtataccataattttggactgtgcaaaggaagcaagcacaccacacgcatagaaaattgcaacgcgtccgatcgcatgggcgagttccgtgaaatcaggggaggcctgttttgttaatggaatgatgtaatcgtcgatcagtgtctgcatgaataaggtaccctgtacactcgaaaaaacagtgataaacaggcagatcacgacaacgatacatgcaaagccatagttcttaaaaatataagagagcaggcgcagcagtagttttcccggatttgcaacatttggtcttggtccgcgtgcattgccacgcataggtccatgatttttttctgccattattttgcacctccttcatcaaaatcaccgcttccctgtgtctgggattcatatacttcgcggtaaatcgcatttgtttccataagttcttcatgggaaccgaagccgtccacaacgccgttgttcaatacaatgatgcggtctgcattcatgacagaggagatccgctgcgcaatgataagttttgtcgtatttgggatttcttcggcaaatgctttgcggatttttgcatcggttgccgtatcaactgcactggtactgtcgtctaaaattaaaattttcgggttctttaacagtgctcttgcgatacacagacgctgtttctgtccaccggagacattggaaccaccctgttcaatgtgcgtgttatagccatccggaaaacggttgataaattctgaagcgcaggcaagatcgcaggcatgccggcattgttcatcggttgcatccgggtttccccagcggagattgtcaaagatcgagccggagaaaagcacattattctgtaatacaacggacacttcgttacgcagtgtgtcgaggtcataggagcggacatctttaccgccaacgtagacggcaccagccgatacatcatacagacggctgatcaggttgactaaggaagatttcgaacttcccgttccgccgatgataccgatggtctcgcctgaggcgatggagagattgatatcgtctaaaacaggggtatcagaggttttattgtatcggaacgtcacatggtcaaagcggatgcttccgtcggttacttcatggtccggtttttccgggtttgtgatatcactcttctcatttaatacttcacagatacgctcagcacttgcgatactcatggtgatcatgacaaaaaccatggagagcatcatgaggttcatcataatgttcatgcagtaagtgagaaggctcatcaattcaccggtggtaagagaatttaccacgatcattttggcaccgatccagctgatcaggatgatgcaggtatacacggcagccatcatgacggggttattaaatacgataacgccctctgctttgacaaacattttgtaaatattttcacttgcttttttgaaacggtccttttcaaaatcttcacggacgtaggcttttaccacgcggatcgcagagacattttcctggacagatgcgtttaagtcatcatatttcggaaatacctgggtaaaatatttatgagccctgactgtgataaaagcaagtatgataccaagtaagatcacggctgcgaggtagatacaggcaagttttgcattgataaagaaagccatgatcatggcacagaccagagtgatcggtgcgcggacgcacatgcgcaggatcatctgataagccatctgaatgttggtgacatctgtggtcagtcttgtgacaagtcctgcggtgctgaatttgtcaatattggagaaagagaatgtctggatattttcatacattgcctttcttaagttgcgggcaaaaccggtagaggctctcgcaccgtattttccccccatcacacctgcaaaaagagagacacaggcagtcacgatcatcagaccgcccatcacgtagatatgatggatatcgcccttttccacaccgttatcgataatggatgccatcatgagaggaatgaccgtctccatgagaacttctaagatcatgaagaccggagtaagaaaagagtcctttttaaactcttttatttgtgctccaagagtttttaacatattttcacatccttttctaatttattgttgatttttatttgttagtgtgctaactatatatttatacggcattcgtctgtgaatgtcaacaatgaatttttgaaggggaaaaagaaggaaaatgagacacgaagacagtgtaggatataaaatgaggttgatccataaccgcattcataagcagatggaagcgaaaaggatcgagaatgagggtgatatcacaggaatgcagcggtggacactcggttacctgaatgaccatgcggatacggaaatctatcagaaagacattgaacaggaatttaaagtgtcccgtgcaacggcttctaacatgcttcagctgatggagcggaaaggactgatcgtgcgggagtccgtaagctgcgatgcgagattaaaaaagatttccctgacagaaaaagcaaaaaatatggttgcaaagtcggatgcagatatccgggagatggagcagctcatcacaaaaggctttcataaggaagaaacagaacagctaaagcattatctcgaccggatcatggaaaatatcggcgtggcggaagactgttgtggcagaaagtgtaaaagtggtgcaaaagagcagaaaaaccacaatatatagtgtttttcttctatcataaaaaagtgacgatttatttgatgtatttttgtacagaatagataaaggtagcatggatactgggtttgcgcggtgtccgctgccttttttgtttacataatgctccacataatatagttatacatattgacaagaacacaatatgttgtatataataaatctcggcagcaatcgttggaacactgccctgacaaataattttttacaattgaaactatagtgaaaattgtttattagataggagagtaaaacaaagatatgaaaattatcaaacgaagcggaatggaagatacctttgacattaaaaagatcgaggcagcgatccgcaaagcaaatgaaagtgtcattgattatgaaaagctgacagaggagaagattcaggagatccttgccaatgtggagaaggcatgtgagaatatgaaacgttctccaagtgtggaagagattcaggatatggtggaaaaccagatcatgaaccagcgtgcattcaatgtggcacgtaattatatcacttatcgttataagcgagctctggtccgtaaatctaactctaccgatgaacagatcttaagtttattagagtgcaacaatgaggaagtaaaacaggagaattccaataagaaccctactgtcaacagtgtacagcgtgactatatggcaggagaggtgagcaaggatattaccagaagattcttattagatggagatatcgtagaagcgcatgagcagggaattatccatttccatgatgcagattattttgcacagcatatgcataactgctgtcttgtaaatttagaggacatgctccagaacggcacagtgatcagtgagacgatgatcgaccgtccaaagagcttttctactgcatgcaatattgcaacacaggcgatcgcacagattgcaagttcccagtatggcggacagagtatttcactctcacatctggcaccatttgtggatgtgagccgtcagaagttccgcaagactgtccgcgaggaactgacagctaccggcattgagccgacagaagagatggtaaacaagatcgctgagatgcgtgtcaaggaagagatcaatcgcggagtccagatgatccagtatcaggtgatcacgcttatgacaaccaatggacaggctccatttgtgacagtatttatgtatctcgatgaagttccggaaggacagcttcgtgatgaccttgcagcagtgatcgaggaagtattacatcagagaatccagggcgttaagaatgaaaaaggtgtatttatcacaccggcgttcccgaaactcatctatgtattagaggaagacaatatccgagagggaagccgttactggtatctgaccagacttgcagcagagtgtactgcaaagagaatggtaccggattatatctctgagaagatcatgaaaaaactcaaacagggtaactgttatacctgtatgggatgccgctctttcttaaccgtatataaggacgaaaatgataaattcaaattctatggaagattcaatcagggtgttgttaccttaaaccttgtggatgtggcatgttcttccggaagagatatgaacaagttctgggaacttatggatgagagactggaactctgtcacagagcattaatggcaagacatgagagattaaaaggaactccttcagatgtggcaccgatcctctggcagaatggtgcactggcacgtctgaaaaagggcgagaccattgataaattattatatggtggatactctaccatttccctcggatatgcaggactttgtgagtgtacgagatatatgaagggagtttcccacacagatccggatggcacaccatttgcattggaagtcatgcgtcatctgaacgatgcatgtgcaaaatggaaagcggagcataacattgatttcagcctgtatggcacaccattggagtcaacaacttataaatttgcaaagtgcttacagaaacgttttggaatcattccgggtgttacagataagaactacattacaaacagctatcacgtacatgtgacggaggaaatgagcgcattcgataagctgaaattcgaatcccagttccaggagctttctccgggcggagcgatcagttatgtggaagttccgaacatgcagaacaatctggatgctgttctttctgttatgcagtacatttatgataatattatgtacgcagagttgaacaccaagagtgattattgtcaggaatgtggttactccggagagatcaaaattgtgaatgacaaagatggaaaattagtctgggagtgtccgaattgcggaaaccgcgatcagaataaaatgtctgttgcaagacgtacctgcggttatatcggaacacagttctggaatcagggaagaacacaggagatcaaggagcgtgtcctccatctgtaaaagcaacagtataaaccaatataaaaattcaggcggagcgggaatttatcccgcttcgtttcaacttatcataaaggaaatcatacaatgaattatgcgaatataaaaacttattcgatcgaaaatggaacaggcgtaagagtgtcgctgtttgtatccggctgtacccatcattgcaagggatgtttcaatgaggaagcctgggatttttcttatgggaaaccatttaccaaagagacggaagatgagatcatccacgatttagagccggactatatggcaggcatcacactgctcggtggagagccgatggaacctgtgaaccagagagtgctggtaaatctgttaaagcgcatccgcaaagaactgccggataaaaccgtctggatctataccggatacctctatgaggatcttctgccgggaggaagggcaaactgtgaagtgacagaggaaatgttatcttactgtgatattcttgtggatggaccatttgttctggaaaagaagaacatttcattaaaattccgtggttccgagaatcagaggatcatccagctttcagccacaagggatgccggtaaagtgattcttgcgatggaatagcaaactgtgatatgatgaacactggcagaaaaatgaacagagaattctggtttcagaaaataaggggagcagagagatgaaaattatgtggaagacattcctggcggtgtctgcctattgggcaggcgtctttggatggttttatataggagtctggcaggtgttgaaaaaaccggtgcattccgtgatactggcacagattgcaggacatctttcgataggacttttgatcggcgcactcatacagggatttttgtatctgtccctggcaggtggtatctggtgtgtcggttatatgatcagtgaatatttcaaagaaagcaaataaggataaacagatgattttacgagtaccttcttattataaaacatttcagtgcattgcagataaatgtgaacacagttgctgtattggctgggagattgatattgatgaggattcctatgattattacatggggattgagggagcgtttggagagcgcctgaaagagcagacggtgacagaagatgaggaacacagctttgtattacagaaaaacggctggtgcccatttttagatcagaacaaattatgcgatatttacagcgaacttggcgaggaggctttgtgtgaagtctgcaccgagtatccacgttttgttgtggagtacggcgatgtcagggaaaaatctttgagtgtgtcctgtgaagaagtaggacgcattattttttctgatgagggtaaaatgtcttatgaagatatcgaactgccggatcttggaattgaagatgaattttacgaggatgaggaggaagaacctttcgaggaagatatggaggagttctgttctcatttagaggagtaccggacacaggcggttgccattttacagaaccgggaaaagagtattgacgacaggatcagggagtatctgaaattctgtgaaaaattgcagaatgtggtggaaaatccagaggaagaactgtgggagccgatggaatattttcatgtccgtatggagacgttcgatgaacttgagaatgtcaacgaggaatggatggaagtaaaacagcgggtgcgtgatttctttgagacacattcttacaccgaggcacttgaggaatataaaaagtccggcgattacaatgaaatctggtatgaacatattcttgtttattttacataccggtattttatgcgtgcatggtatgacggaaatgttctggcaaaagcacagttcgcaattgtgggatttttagtgatccgcgatatggatattgtacgatattttgccaatggaaaaagtttcaagttggacgaccggattgcgaatgcaagaattttttcaagggaagtggaacattcggaggagacgttagagattctggaagatgatatttcttttgatgaagcttttcatgtaaagcatctgcttggacagatataaaaaatagccgggtgacagagtaccggatagctttgcgctatcgttctgttcagccggctattagtatctgcctgtaatgaaatgcaggaaggatactggttttttaccttctgcttttgtctctgtaaggtatttctcatagtaaagaattacttcaccgaaagacattgctggatcgattgtatacatatgctcgcctccttatatttgatttcttttcttgttttcgaggctagtatagtactggttttgggaaaagtcaacaaaaaaagtgtgaataatttgttaagtattcacaaaaatacaattttggggtaaaaagtaaaaagaaggcaaaaacgaagaaaaaagaatacaaaaatggggtaagggagaatacaaaagagttttatgaagcggagtgacgaagagatttacgaagagcaggagcgcagaagaatacatgcgcggcgagagcggagaagaaagagacgaaagcagcagatcatttttcgggcagtgacgtttaccgttttttttctggtattgcttcttattgtaatgctggtgcgcaaagtggcagataaatcagcagcagaggaggcagtggtatcagagcctgtcaagtatgttgaggaatctccggattttgcggtagagctgctgacggtcaatgagtattccagaccgggaacagagcttgcgcaggtaaatgggatagtcgtccattatacggcaaatccgggaacgacagcggagcagaaccgcagttattttgaaagtctggcagagacaggggagacgcatgccagcagccattttattattggaatcagtggggaaatcattcagtgcattccatgtaatgagatctcttatgcatccaatgacagaaacagcgataccatctcggtagaatgctgtattccagatgagagcggaaagtttacagatgaaacttaccagtcattggtcgaacttgtggcatggcttatggggcggtatgatctgaccacagacgacgtgattcgacattatgatgtaacaggaaaggattgtccgaaatattttgtcgaaaacagtaatgcatggtcggatttcaagacggacttattgacatatatcgatacctacggtattgaaaaaacacaggaaataaattagaatagcttatgaaccggacttttttgttgcaaaaaacaaaataatgatggaaacaatcggataaagggttaatataggaaaatatgttggaaaatgaatttcataaattagaagaaaaacaggaaatcagaacgacgatcagtcagatcagaaaagaaatcaagaagcaggacagtaaaaaagcatttttggaactgctccagggaaaagagtccatgatcgttgatttcttatcagaggaagatgcaaagacaaggaaaaatacagcacttctgattggggatttaaagcttgaacaggcaaaagaagcactgatcgcagcctatctgaatgagacaacactatatgtgaaaagtgcttatctgacagctcttggaaagcttgatgtcagggaaaatcttgaatttttcaaaaaccgtctgcaggaagtaaaaaatcagcaggtgcctgctgaggaacaaaaacatcagggcgaagagatccgggagttaaatgagatcatactgaaaacggaaggggcaaaaaaacatcagtttaccggttttcagatgccgcatgagatgctgcttctcacaaaccgggagcagagggaggtcacgttttccgaagtaaaggagatcggggcttcggtacagagaaaggcagagctgcatccattgggagtactggttttttcgaaagaagtgactccatttacaaagcttcgcacttaccgggaattattgtttcctattcacacaaatgaaagaatccctgcaatgccgcacagggcggcagaattattatggcattcggatctctatgcatttctgacggaatgccatgagggagatgcaccatttttcttccgtctggaggtaaagagtgcagaaacgaaaacagagtttgtgaaaaaattaggtgcgtcactggaaaaaaaatctgactggaaactggcgaattcgaccacagattatgagattgagatccgtctgatcgaggcgaaggatggaagctttgttccatttttgaaattatattccatgaagatgaagcggtttgcctaccggaaaaatgcgattgcaatgtccattcatccggcaacggcggcgatgctcatgtatctggcaaaaccatatctgaaagaaaatgcacagattttagatccgtgctgcggtgttggaacaatgctgatcgagcgcgatatcttagttccggcaagggaaaaatatggaattgacattttcggtgatgcgattgacatggcaagagagaatgcagcacttgccggagagaagatcaactttatccaccgggattattttgattttaagcatgattataagtttgatgagatcgttaccaatatgccggtaaaaggaaagaaagcaaaagaggatatggatgcattttatgcccgcttttttgaaaagtctaagagtctgctggctgaggatggaatcattatcatgtattccaatgaggtagggtttgtaaaaaaacagctgcggctgcagccgtgctacaggctgatccaggagtatacggtccggaaaaaggattcgtactgtctgtttattataggaatgaaataacaatttgaggggtaacagggatatggcttttacagcgggcaaaagcaaagaaattgagggaaaatcaaatgactggctgttagatcagtctttaatgcagagcatgcaggaccggttctgcgatgcgaacaatgtatacatggtatgcctgaatgcacagaacggggttgtgacaaaagcatatggaacaaaagaggaattggaatatgtgtacagcaaagcgggcagggagcgtcatgtttcgcttttggacaaaatgaccggacacagcattgagagtgtggtggaggaaccgttagatacagattctatcaaaatgagcggtgtggcgatccacgtcagcggcgagacaatcgcagtctggatcgtgatcggtatcatggataacagtacggaagatattccggattatatgatgcggacaagtccggagcgctattacaaatcgttggagttcttagagtcactctcaaaacagatttttgcagtaaaaatggaggaagtgttagcgcaggaagcttttaacaaaagcagggaatctgagatacagatgaaggaacagctgcacagaaatgaagcaatgacctccattttaaaaatgcttgagtcagaaaacagttttacaaaaattgtggacgacattttaaaagatgcctgcgagtatctggggatttcggcaggagcactgctccgggaaaatcaggagcagaagacggtggatatgatctgcgagtatgccggcgggggacgtgagccgcagatggcaaaggagcagggagtcccgaaagaagaacttccgttttttaacggaaagccgtatatgatctcgtcggattccatgatgccggagggatttgcacgtctgtttgcacagaaaaaactgacagcggctgtttttctcccggtggaggtgaacggacatgcgggcatgtatctctgtttttgtgaaagtgagaaaaagaaaaaatgggaaaatgcggatgttaaatttatcaatgacgtaaaacgtattatccagacaattttaaccaaacgtatcacgaaaaattcgcttgcaagttcctatgcatctttagaggcaatccttgaaaatgtgggatgtgcaatttatgtaagagatccacagaccggacatattctgtatgcaaacgagaaatatcagaaattctttaaaaagacgttggaggaacttccactcagccctgtcagcttacaggatgcgaccgagacaaaaaacggtctgttccgggaaatttattccgagaaggaaaaccgatggtttgactgctacagcacccatatccagtgggtggatggaagaaaagtgacactctgtacaatttatgatgtcacagataaaaaactgtaccagcagaaaatcgagaaacaggcaaacaatgatttcctgaccggcttatacaaccgtatgcgctgcgagcaggatctgcagcattttgttgaagatacacatgaatccggtggagagggagcacttttatatattgatctggacgacttcaaacatatcaatgacggattgggacatcagtatggcgatatcctgctgaaaaatatttcttccggattgaagcagatcccgggtgtgaatgacaattgttaccgcatgggtggcgatgaatttattatactgatctcacataaggtatatcctaatctgcataatatcattgaccggatcaaggcagaatttgcaagaccgtggaggttaaaaggaacggagtattactgcaccatgagcatgggagttgtacgttttccaaccgatggggattccgtggaggaactgatcaaaaaagcggatattgcgatgtatgatgcaaaatgtacgggaaaaaaccgtgttgcctattatgatgaaaatgtgatctccacatctttcaaacggctggatctggagaaaaatatgcgcaatgcgaccagaaatgcgtttgatgaatttgaagtttattatcagccaatcacggatatttcaaaaccgggaatgccatgctccggtgcagaagcactgatccgctggaattcgagggaacttggcgtgatctccccgacagagtttatcccactggctgagtatttagggttgatcaatccgatcggaaacttcatcttaagggaggcctgcatgcgctgcaaatactggaatgatatggggcatccggattataaggtcaatgtcaatctgtctgttgtacagctattgcagaatgatattgtggagcagattgctgaggtcatcagcgagacagggatcgatccaaagaatctgacactggaagtgaccgaaagcctggcgatcaacgatatgaaccgcatgacaaagattcttgcggatatcaaaaaacttggtgtgcgtgtggctttagatgatttcggaacaggatactcttccctgaaccatatccgggaaatgccgatcgatgtgatcaagatcgaccggtgctttattattgatatcggaaaggatgatttttccaatgcttttgttaaaatggtggcggaattggcatccgccattgatgtcaatgtctgtgtagagggagtggagacgaaagagcagctggatattcttatgggaagcaagatccagctgatccagggcttttattttggaagaccgatgacggcgagagaatttgaggagaagtatttataatcctgtaacctctgatacggtgagcacgttgtcgtgtacctgaaagcggatgttgtagtttccataggtgagtccccagatgcggctgttgtcgtggatgaatcggtctcttggatcctgggataaaagctctgacagcagtttccggtcagcttccgggatcttttgcagcagatggtctggaaaaataacttctaactgctcactgcttacagataaagcaaaaccgcctgtggcttccgggtggctgtcgatatgcggcagataaggcttgatgtcgtaaatgggagtgccatctaacatatcaataccggatactgtgataatgggaccgagcttttcgtccattgtgacagattccagttttacggaagacaaaccaatcgggttaggacggaaaggggagcgtgttgcaaaaatacccatacgcacttttccaccgagccgcggcggtctgacggtggcagaccagtgatctttttttgctttggaaaatccccatacaagccagaggtgggagaagtcattaagccctcggatggcatcagcatttctgtattccggggaaaaaacaatcgttccctgcaatcccccgacaagtccgctctgtcttggaatcccaaacttttccggaaaatccgtatgaatgacagcaatttcttttaattccataataagaagcttcctctatttcatgatgatcatatagttcatttagataacaaaaaagccttgatacaatcaaggctttctctatgcagaagatgggacttgaacccacacgatattgctaccacaggcacctgaagcctgcgcgtctgccaattccgccacttctgcgaacaaacactattatatccgggtttatagaataagtcaagactttttttgaaaaaattgttttaattgtatgaaaaactttttacaattttttttgaaaaaagtggttgacttttttgtttttctttgctattattaggaagtcgtcacgagagatgactgacatgcggaagtgtcggaactggcagacgagcaagactaaggatcttgtgctcattgcgagcgtgtgggttcaagtcccatcttccgcattagagaaagaaaagaggaaaccttttaatatggaggtttccttttttttcatgttttgaaaatcgagatgtatatgttgtgtaaaacaaaaagttacaggcagattatagaaccggcttccaaaccgattgaaaatctggataatcgtttgacattggaaggatttcgagcttggtatgaggaagggaaaaaagatggtatttaataaaacggcaccttgaacaaaaaaagcgaggatgccggaatcaatcattgagacagagcaattgccggagctgtcgtttataagaaaagtaaatatctgatatattatggacaaaaacagttgacgaagatgaaaatattgataaggaaatgatagttctaatttcagaaacatttggaggtcacaaaatgaaggacacaagttataaaaataaacaattcgtacttttaggaatgacttttttaagcgtagctggtattgccggatgttccaaggtggaactggcacagagcacagtgacactggagcttggcgatgagctgtctgaaaatgttgcagattatttacagaatccggatgagaaaatcttaaagggcgcaagccttgatctgtccacaatagatgaaacaaaagttggctcgtacaatgctgccattgcatatgatgggaaaaattacccatttacggtagaagtgaaggacacgacttcaccgcaatgcgaagcgaaagattatatctacatgcagccgggaacgctgaccgtggatgatctggtaacggagatcaaagatgcatcagaaacttccagtgggattgtatcttgtgagcagaaggatgatcttgtagtctgtgattatgatgatatgctgcaggaaaaagcggcggtagataatgcagagccgcatgatggagcagattatcaagaaagtgttcagttggatgatgaaggctgctatgaagtgacagcgcaggtaaaagatagtgagggcaattttacagatataacattaaacgtttacgtggatggcacagctccggagctggcacagaatgtgattgatctggacgtggatgcatccgggatcagtattgacgacactaacacggatgatgcggaaaagattgcagacatgctgcatgagcttccggattttacagatgcggagtgggcggttgcgagcgatgcattttgccaggacaacaaaatttcatacgagtttgagcagaaatcttttaatctgcagaaagaaaatccggttgaagtattaaatgtatactgcacagtgcaggatcaggctaaaaacgaaaacgaggcagattacgaagtgacggttacatacactggactggatgtagaggctttgttggaaaagacagggttgattatgcagataagtgatgttacagccaacgacaagaaatctggcaaaagtgataataaatctggaactacaaatactcaaaatcaattatcacaagccagtggaaaatccaatgcggacaatttaggaatgacggatgatgaaatggttgcaatgttacaatcaatgacaccggatgaaatggatgcatttttaaattctgtagcttatggaagtaccacagataataatgttcaagtatctggttattatgacaacaatatggcacaagaagtatttaatttgacaaatcaagaaagagcaaataatggtttgtcagcatattcatgggatagcaatatggcttcatattcagatagacgtgcaaaggagatagttacagattatagtcataattctgtaggtggaaactggagtgtaggagaaaatattgcagaaggtgaaacaagtgctagtgaggtagttaatgactggatgaactccgcaggacataaagcaaatattttgtcggatgtgtctacaaaaacatcggtatcttgttatgttgaaaaatttacatatgcagatggatcaacacagtatttgtatcattgggtacagaattttacacattaaaagcattcctttaaaaatttaataaattgcactgattttattggtttggtataatgaataaggtgctacgagaaaacggtaggcggttagccctcaacagagggactgaaccctctgattacataaaaatcttcgtaagaagaaattcgtaaatggaggggatgctaatgataacactgacggaacttattcagttcacgagtttattgataagcgttgccggattattttacctgatcgggaaagataaccatggcaaaaaaataaccgccactgtctgagaaaacttggcggttatttgagcaattagttattcaataggctaaccgtctatcggtagcacctttttataaattggttataccatatttatactaaaatgtaaagatagcatagttctaatttcagaaactacgagggaagaaatatgtacatagagtttgaaaaatggttgaataatattttagaggaaaatatgccgataccaggagctgctataaattttaatctttatgaagaagcagatttatattggtctatacaactgatttgtgcttcgtattttgatgaagaagatgaagactggtgttgtgaagaagaatttagctctggagaaaatgtattctgctggaaagcagagatgggatgggaagagatattcgatatttcctgtcaaatgataaaacagtatatttctgaggggaaatatgcagaagaattgaaaaaatatgaagcaatttcggctggatttgtagatggagatttgaaaattctttatcaaaagtgaataatttaaaatccggtttgttccccataatattggtgcatatttgcgtaaaagaatcacagcttgtagggatgaatacttatgaaaagtaaaagaaatagtcaagtttcaaagtgagaatgcaggaaaagcaaattaaaaatgataaattgggtaatatttataaagagttaataaatatagttaatggttatccagatagatcaccaaatgatgtccttcgtaatattgaatttgcacctagttattcgatggaaaaatttgagagtgttatagagattttgaatattcaaattgaggactataagagacaattaaattttgaacatttaaaaagagaacgacgatatgatatagaaaatcaaattagcaatagagagtacgcaataaaaaaaataaataaaatcagagatgattattttggggctgaagaaaaataccggaaatttaataaagaggataaggcaagctttgatttatatgcaggacaagaagtaaagaataaactaagagaatttaatgtcgttaagaaaaatacatttatatcaggattgtacgtgggagaggatccagattcattaaataatagcattaataaagcgagagagcagttaattgagagtatgcgaaatgatttgaaaattgaaaaaagttaaagtgctttgttaaataaattgttaaggaaacaatcggagttggtgtaaacgaaaaaagcagttgcggacggaataaaaatgatattttttgttactgttcactcagcacctgaacaccatgctgttcaggtgcgtatgaacgtgatgtgggtgtgagcagcccccttttgcgaagcaaaactttatatggggctgcgaagttacagttcgcagggtaacctgtgaactgtaactattttttgtcggaaaagaatattttttatcaaatagtttttacatttgccggaaaaagcgttataatacgacacgataaaaaaatgtgaggtgatgaaagtgttttttgaaaaagcaaaagcgaaaaatgcaagagtccagatgtcggaggcttttatcacgagtgtatttttggcactttccggcggatttcaggatgcatatacttattttacaagggatgaagtattctcgaatgcacagacgggaaacgtggtactgatgagccagcattttatgctgggtgaatggcagagagggctgcattatctgataccgctgctcgcatttgccggaggcgttttctttgcagactgtgtacagggaaagtttaaatatgccaaccgtcttcattggaggcaggggatattattgttggagatcctgattttatttggtgtcggatatattccgcaggattataatatgcttgcgacaacattagtgtcgttctcctgtgcgatgcaggtgcagtcattccgcaaagttggcggatattcttatgcgagtacgatgtgtatcggaaacttaagaagcggcacggcagcgctgtcagcatacatgagggacagacgcccggagcagatccggcaggcgatgtattattttgggattatcctgttttttgcagtgggagcaggaatcggtggaaatctgtctatgcggcttggatttaaggcaatctggttttcaagtgctgttctggcagtcagctttttgttaatgtttatagaagaaaaggaaaaatcattatgttaaaccagttttcaagaacggagttattattgggaaaagaggcgatggagaaactcggacattccagagtggctgtctttggtgtcggcggtgtcggaggctatgtctgcgaagcacttgtgcggagtggtgtgggagcgtttgatctgatcgatgatgacaaagtatgtctgacaaacttaaaccgccagatcattgcgacaagaaagacggtaggaaagtataaggcagaggtgatgcgtgaccgcatcctggaaatcaatccggaagcagatgtacggatccataagtgctttttcctgccggagaatgcggatgattttccgtttggcgaatatgattatattgtggatgcggtggataccgtaactgcaaaaatcgagcttgtcatgaaggcgaaggaaaaggatatcccgatcatcagcagcatgggggcgggaaataagcttgacggaagccagtttaaggtggcagatatttataagacaaaagtctgcccgcttgcaaaagtaatgcgccgcgaactgaaaaagcgcggagtgaagaagttgaaagttgtgtattccgaagagattccaacaagaccgatcgaggatatggccatcagctgcaggacaaactgtatctgtccaccgggagcagggcacaagtgtacagagcggcgtgacataccgggaagtgtggcatttgttccttccgtggcaggactgatcattgccggggaagtggtaaaagatctgatacggaaataaggtgtatcacaccagttggataaatatatagacaaatagaacccatataagttataatgttgtgcagtgctgtaaaacaataaaatgaaaaacgagggaaagatatgtttataattcagtttatcagaggtttctgtatggcattagcagacagtgttccgggtgtatccggaggcacaattgcatttttacttggattttatgataagtttatcgattcaattgatgatctgctgaccggaataaaagaggagagaaaagacgcatttgttttcctgatcaaacttggaataggatggatcagtggatttgtgatcgcagtactgatcctgacaagtgtatttgaatcacatatttattatataagctccctgtttatcggatttattatttttgcgatcccgatcgtgataaaagaggagaaaaaatgtcttggaaccaataaaaaggcgataccgtttgtactgcttggaattgcggttgtatgtgccatcacatattttaatccggtttccggtggaaatgacggagtgaatctggatcatctgacaccggggcttgcggtgtttgtgttttttgcaggagtgatcgctatttcagccatggtgcttcctggaatttccgggtctaccctgcttttgatctttggattatatcttccagtcatcactgcgatcaaggatatgctgcatttggatttctcgagcttctggacggtattgatttttgggtgcggtgttttagtcggcattttcagtgtagtaaagctgatccgcagggcattggaaaagtacagggcacagacgatttatctgatcatcggactgatgctcggctccatcttcgctgttgttatgggaccgactactctggatactccgcagccggctatgggaatccatgattttagtattcttttctttttgattggcggtgcagttattttaggactgcagaagatgaaggatattaaacaataaacggagtagaagacgatggtttgaaaaagacgcacagcatagtgcggataagcattggataaaacagcataatagggacagaaggaaaccggcgcaagtatttgtgccggtttctgtattgtcttaaaaacgaaaggaattttaatgggagaacaggaaatgggaaagttattggtgtacctgaaagattataaaaaagaaagcgtgttaggaccgctttttaaattgctcgaagcgtcttttgagctgatcgtgcctcttgttatggcggcgattatcgatcatggagtagcagacggagataaaccatacattatgaaaatgtgtctggtacttgtgctgcttgcagtgatcggattgacgtgttctatcacggcccagtattttgcagcaaaggcagcggtcggtttttccacaggactgcgccacgcactttttgagcatattcagaaactatcattttcagagatggatactgtgggaacatccacactgatcacaagaatgacaagtgatatcaaccagacgcagaatggtgtaaaccttgtattacgtttgtttctgcgctcgccgtttatcgtgttcggtgcaatgatcatggcattcacgatcgatgtgaaagctgcacttgtctttgttgtaacgattccgctgttatcggttgtggtattcggaattatgcttgtgagtattccattgtataaaaaagtacagtctgcactggacaaggtgcttggaatcacaagagagaacctgaccggaagcagggtgatccgtgcatttaataaagaggatgatgagatcgcagactttaataatagtaatgatgcactgacaaagatccagctttatgtaggaaaaatttcagcgctcatgaatccgcttacttatgtgatcataaatggtgcggttgttgttttagtatggacaggagcaatccgtgttaacagtggatatatcacacagggtgaagtggtagcgctggtaaattatatgtcccagattttagtggagcttataaaacttgcaaatcttattatcaacattaataaatctattgcatgcggaaaccgtattcaggcgatttttgaattacagccatccatcacagataacgcgatgactccagtggcagagaaaaaagcagagcacagtggtgaagtgccggaagtggtattctcccatgtggggttaacttatgccggagctggtgaggaatccctgacagacattgattttaccgtgaaaaagggagagacgatcggtatcatcggtggtactggttccggaaaatcgtcggtagtcaatttgataccgcgtttttatgatgcgacaaagggaagcgtgcagattgagggaaaagatgtgcgtgagtattcgctggaagaacttcgtggaaaaatcggtatggtactccaaaaagcggttttattcaagggaacgatccgcgaaaatatgttatggggtaatgagaatgcaacagatgaggacatcatgcaggcgttagaagttgcccaggcaaaagagtttgtagataaaaaagaaggcggacttgattttgaaatcgagcagggcggtaagaatctttccggaggacagagacagcgaatgacgattgcccgcgcggttgtgaaaaaaccggatattctgattttagatgacagtgcttctgcactggattttgcgacagatgcaaaacttcgtatggcaatccgcgatatggagaacaaagcaaccgtatttatcgtatcgcagagagcagcatccattatgtatgcagacaagattattgtgttagatgatggtcagattgttggaatgggaacccatgaggaactcttaaaacagtgcgaagtatatcaggaaatttattattcccagtttaaaaagaccgaagatgagaaggagggaagataaatgaaaaagaggatcaataaccatcagagatcaacgatcaaaaaagtgatgaattatatcagaagatactgggggtatcttggaatgtccattgtccttgcggcagtgacagttgcattgactttatatctgccggtattgaccggacgcgcagtcgatctgatccttgaaaaaggagtggtggattttgcagggatccttgcaatcctgaaaaagatggcagtcattatccttctgactgcagctgcacagtggatcatgaatgcatgcaacaataagatcacttataatattatccgggatatccggaaggaagcattcgaaaaaattgaaagactcccattaaaatatattgacggacattcctacggagagatcgtcagccgtgtcattgcggatgtggatcagtttgcggatggtctgttgatgggatttacccagtttttcaccggcattgtaaccattttaggtacgttgatcttcatgctcacgatcagtgtgaaaattacggtggcagtcgttgtgatcacaccggtttcgctgcttgtggcaagttttatcgcaaagaaaactttttccatgtttaaattacagtccgagacgagaggagaacagaccgcatttatcgaggaaatgatcggtaaccagaaggttgttcaggcgttttcccatgaggatgaagcactggaaaagtttgatgagatcaatggcagattacagaaatgttctttgagagccattttcttttccagtatcacaaatcctgcaacccggtttgtcaacagtctggtgtatgcagtcgttggcgtggtaggagcatttaccgcaattgcaggaggtatttcagtcggacagctttctgcgttactcagttacgcaaaccagtatacaaaacctttcaatgagatttccggtgttgtgacagagttacagaatgcgctggcatgtgcagcgagggtgtttgaattgatggaggagccttcggaagttccggatgcgccggatgcagtgaatttggaggaggcagacggtcatgtggcgttagagcatgtatctttctcttatgtgccggaacagaaactgatcgaggactttaatctttctgtaaaaccgggacagagggtggcaatcgtcggtccgaccggatgcggaaaaacgacattgatcaatcttttgatgcgtttttatgatacaaacagcggaacgatccgtgtgagcggagtgccagtcaatgatatgacaagaaagagtcttcgaaataattatggtatggtattgcaggaaacatggctgcgcagtggaaccatccgtgataatatcgtgatgggaaaaccggacgcgaccgatgaggaagtgatcgcagcggcaaaagcttcccatgcacacagttttatcaagcgtctgccgcagggttatgacaccgtgatggcagaggacggcggtaatctttcccagggacagaaacagttgttatgtattacccgtgttatgctttgcctgccgccaatgctgattctggatgaggcaacttcttccattgatacacgaaccgagatcaagattcaggaagcgtttgcaaaaatgatgaaaggacgtaccagttttattgtggctcatcgtctgtcgaccattcaggaagcggatattatcctggttatgaaagatggtcatattattgagcagggacgtcatgaagaactgctggctaaaaagggattctatgcaaatctttatgagagccagtttgtaaatacatcctcacaggcataagaatttttgaaaaacaaaagttatactaatccacataataaatggtgcgtgagccgtcaatgctctccattgtggaggttgtgataaaatctttgactgcttctttatctcttgcgagaaggcagtcaaagattttttttgcactgtagtataattctttggtgccgtatttttgtccgtagcgaacccagaggctgcatacaagatcgcggaacgagacaaaaaagagtgggagcagagtgttgccactgatgtaggcaatctcgtggctgaactcaaaaataagagaagcagtcttttccgggtcagtacagttttccatctggtagacatattcctgaagccctaacagttctttatctgatgcacggtcaattgcaaactgggaggcttccaccataaacatgattcttgcttccagtacggattttacttcacggttttttaaaacgccgccattgtaattcatgatggcaacgagtgtgtctaaagaaccgtctctgtgatagtctgctacaaaggttccgattcttggacgaaccacaagaaaacctttcttttccagttccgcgataccggagttgatgaccgcacgggacactttcatggattccgccagttcgcgttccggtggcagtttggatccaatctcaagtttgccggataatatcatattttgcagttcatttacaaaaagttccttcagggaaggtgcattcagttttttaaattccataaaatctcctgttccttcatgaataagtgcgtgcgaaacttccttaaggctgtgctgaattatgaagattaacaaaattttcgaaaacacgctttcgctatgtgtcactggtaacggtactaagaagccagtcacgacttacgtcgcacctgccttctaaggaccgaccgttccccaatgttttctcaagcttttgtcaattttcataattcaatttacgtttataagagtttcgcgattgtctattatgaataagtgtttgtgaaactctcttagtaatattgattttttgtcaagtattctatgttttagggaatttcacaattattattgaagtttgatatctgaaatattaagtttgtctctggatagaccagataccacgaaactattttataaaagatacaaataaaaatcaatgattcgacttattaaatttttgtgaaattgacgattcattatctggcagagacagaaccggaaacttgtattttaagacagattcagatataatcaaaggaagcatgaaaagagtggagtgaatcatgaagaaaaagacagtgacttctgagacagaagaaattacaatagacaataaaaaaaagaaaagaaagaaggaaaagaaagcctaccgggagatccgttgggacaggctggataacacggcacatctttttcctgtgatcgcaggagagaatatgagcaatgtctaccgtatcagtgtgacactgacggagctggtgcagcccgatgttttacagcaggcgttaaatattgtccttccgaagatggatggatttaatttaagacttcgcatgggggtattctggtattattttgaggagaatggaaagcctgcaccgaaagtacgtgaggagagcaattttccgtgccgctatatccagcagaatcaaaaccacagttatatgttccgcgtgacttattataaatacagaattaatctggaagtgttccacgtgctgaccgatggaatgggcggcattaactttttgaaagagttaacttaccagtatctgcgtcttgcgcacccggaactgaaggagaaggtgggggattccttaaacagtggtacatctttaaacagagaggacagtttcttaaaaaattataagaagagttctgcaaaaggctatcagacaaaaaaggcatatctgttaaagggagagcatctgggaccgggagaattcggcgttatgcatgggtatatgcagattccgcagctgaaagaggtatgtcacagatatggctgcagtatcaatgaatatcttgtttccgtttatatctggagtgtgtatacggagtgtatgaagggaatgccgtccacgagtccgatccgcgtggcagttccggtaaatctgcgcccatattttaattcgatcacaacaaagaatttctttgtcatggtgtcggcagaatttcatccgacaaaggaagtctacacgtttgcggaagtgctggagatcgtgcgtgataatctgagaagccagatcaacagggagcatctggaaaaactgttttcgtataatgtatccaatgaaaagctgctggctgcgcgtgctgtgccgctctttttaaaaaatattgcaatgaagattgtgtatacaaagtcggcacttgccaatacaacaacaatcacaaatatcggaaatattggagtggatgaggcataccgcccatatgtggagatgttccatgcgtttcttgcaatgtcgaagggacagcatttgaagggaacaatctgttcttatggaagtatgttagtgttctcgttcagttttgatctgaaagatgtttcggtgcagcggggatttttccgcaaaattgcagcagatggaattgaagtagagttagagacaaatggtgtgacttctgattaagaagaatgaattatgatacaaataacaggaaagtaatggtgtgagatgagcagatgtagacaatgtaatatagaagttttggatgagacggagcgctgcccgctctgtcactccgtattagagcctacgatagaggtggaaaatatgtatcccgatgtcaagatcaaaacaagacggatgatgcttttgtcgcgaatttatcttttcgtggcgatcgtggcagaggcggttttagttgcagtgaatcattacggtgattttgagacggcgtggagccttgttaccggtctgatctttttttacggatatctggttgtccggtttgcaatccttggaaaaaccggctatattgccaaaacaattgttttgacgttgattgccatattaattttgatcgcaatcgattttgtgagtggttaccggggatggtcggtacggtatgtgttcccggcggcgatcattttagtcgatgcaggaattttgatcttgatgtgtgtgaaccggaggaactggcagagttatattatgtggcagatttttatgattctctgtagttttgttccgatcattctgtatctgaccggaatcatttatgtcccatatctggcacttgcagcgctcggaacgtctgtatttttgttccttggaacgctgatcatcggtgacagaagagccagggtggaactgaagagaagattccatatcagataaggaaacgacagaagtttgaataagagggtttatgatcagaaaattgactttgaaaaaagaaagagaacatgagacaaacgaagcgagcatcgcaggaaatgtcatgcgtgacctgatcgcgcatgtgacaaacgataacctgatcggcaggaagatcaaaagcggtgagctgcgtaaaaagatggttgagccaccatggaaatgcccggatatgttcaccatgaccactatcgagatggagcacttcacaatggagtggcttgaattaaaggaaaatccgaatgagcagaaggtgatcttacagcttcatggcggtgggtatatcggagcgatgcggaacgcataccgcatgtttgcgggactttacaatgaagtcagcaaagggatgagtgtactcaccattgattaccgtgtggcacctgaaaatccatacccggcggcattggaagatgcagtgagcgcatatcagtggctgcttggtcagggctggtttgcagaggatatcattgtgtcaggagattccgcaggaggagggcttgcgatggcactgtgccattatctgaaagatcatggaatgcagcttccatgtgggatcgttgcaatgtctccgtggacggatcttatggcaagcggtgaatcgtatgataccaattatgagagagatccattgttcggaaatacgagggacagtctgatctataacaaagattatgtgggagaccatgatccgatggatgcttatatttcacctctgtatggggatttcaggggatttccgccaatgctcatacaggtaggttcttatgagatgctgttaagtgattcggtgagcgttgcctcgaaagcgagacatcagggtgtgaaagtaagactcagtatttatgatggaatgttccacattttccagatggcagcaaaaatgctgccagaatccagaaaagcgtgggctgagattggaaaatttattgatgttttgtcaaatgactgacatccatataaacaggaagaccattttcataggtgacattggattccccctgaatcaatggagtgaggtaatcaattaattcctgtgtaacatcattgccagcggcgttgatccattcagcaggaacggatctggcttcgttggcaatattttttatctcggcatatccatattcaatcgtatatggatcgtcagatacacggttcatggtgaccatagaagctgttacgccttcctcggagagtgcaacggctttttttcctaattcgacagactccataagatctgttttggatgctaaatgggctgcacatcgctgtaatacattcacttcgatggaacggacctttacacctaatttttcttttacaaggaattccaatgtttttccggcgccactcagctggctgtgaccaaatgtatcgacagactgctcagaagcactgatgtagttgccggaagcatcgcggataccctctgagactgcaatgataacgttattgcgctcaaacagcatacgttttacgtctaacaggaagtcgtccgtgtcaaatggaacttccggaagataaatcaaatgtggagcggaattatatccgtttcttgcaagagcagcggcagcggtcagccatcctgcgtcacgtcccatgatctcaatgatcgtgacactcttgactgcgtaaataaaagtgtcatgggcaatctctaaaacagaggaagcaatatattttgcagcggaaccaaaaccaggagtgtggtctgtctcacacagatcgttgtcgattgtttttggaatgccgatgatgcggacattgctgccgatttttctgccgtattcagataattttaaaacggtgtccatagagtcgtttccgccaatatagaagaaggcgccgacattgtataattcaaactgtttgaagataaaaacatatgaggaatcatcatccagataatccggcagtttatgacggcaggaacctaaatacattgccggtgtcgtttccagacgatccagatatgccggattttcattcataatctctgtcagatttaataaatgattgtttaagatgccaaggattccatttacagatccatagacagtctcatactgatcagatgccatgactccacggattacacctgcaaggctggcgttaattgcaactgtcgggccaccggactgtgcgaccattacattttttaaactcatagtttactccttaataattcattaacttttgttaaaaatagtatccatttctttttcttttgttataatgaaaaagatagattttttgaaaaaatctttttgactgctatataatagcggaaaataacgtgtttagcaagaggtagcaggtgtgaaatgtgatttatgtccaagaaaatgccttgtagaccggaaaaagggtgaaaaaggaatctgtgggcagacagaaaatttaaaagtagcgagggcggcacttcatttctgggaggaaccttgcatttcgggagatgcgggatctggagcggtatttttttcggggtgtccgctgcattgtgtattctgtcagaatgagaatatcgcaaacggaacggttggaaaagaaatctctctggagcggctcgtggatatttttcttgaattgcaggaaaaaagagccaataatatcaatcttgtgacaccgggacattttgtgccgcagatcgtgaaggctctggatcaggcacgaaaggaagggcttacgcttccggttgtatacaatacaagcagttatgagacggttgacacgatcaaaatgctagagggttacgtcgatatttatttgccggattttaaatatatgagcccggttttgagtaaaaagtattctcatgctccggattatgcagaggttgcaaaggcagcgatcgcagagatggtgcggcagacaggaaaggctgtgtttgtaaatggagatgaagataaccttattttaagtggaacgatagtaagacatctgacactgcccggttgtatggcggattccatgcagattttaaaatatctgcatgatacttacggagatatgatttatatcagtatcatgaaccagttcaccccgctttccaatctggaaaagtatccggaattaaatcgcaggattaccgatgaggaatatgagacactggtggattatgcgatcgagatcggaatagaaaatggttttatccaggaggggaacacagcggaagagagttttatcccggcatttgactgtgagggtgtgtaaccttgaaaatgagaaccatattttctggtggaaaaaatttccaaaaaaataaggaaaattatatttacataatatgggaaaatgctataattagcttcgtatgattacaaagaaggaatagcagcgaaattactgcagacagattctttatcataatagagtgaattacgaaaatttactgaaagtaaaggaaaatgcagacgaggaggagacgagaatgaattttctgaatttaattcagggcgcagccggaaaggtaaaaggggttgcgactttgcttagcggactgacaaagacacaggcgatcatagcaggtgtagctactgtgacagcagttggcggtgtcggaacaggaggatatttcttatatgaccattttcatcagccggaaccaattgtggcagatgttgtgataagtacagaggtggcagaaccgacggaagaagttgtggcagccgaagaagttgtcacggaagagacagaggcggcagaaccggaaaccgttacattggtcggaagttctattgagaaggatctgaagatcaagatacaggacgagtcctcgaaaaatgtaaagggacagccttttgagatcacgatcaaggcagacaagaagaaggcaaaatcaactacatattcagatgatgataaagatggtattatttacattaaaagtattgatgccggaaaatatgatgtctctttgaatgagattgatggatatatttcaaaagaaaattcttacaaattaacggttaaggataagattgaatacaccaaggtagatgtcaaagacgagatcaaatccgcatcagaagtagcaccggcagaggatgcagaggtagacaatgttgaggtggaggctgttattcaggatacagtggaaacagttgacagcacctgtacgccatccaaagtcggagcaggagatgtggatacttccaatttcccgaaagcttctgttggtggatcaacaaaagtggacattgcacaggcagcagtgacggcttccgcaaaacgtgtgggataccatgctacaggaacggaatcatctggtgtgactacatcatccgagacatcatcggaaacagcaacaccaaaatcatcagaaacaacagcaccaaaatcatcagaaacaacaacaccatcggaaacgacaacaccgagtgaaggcagttcggaaactactggtggtcagggaactggcagtggtcagaataatggttctggaaatagtggaagtggtgagagtacaggtggtcagcagggagcatctggtggaaacagtagccagaatggaacatctggagacaaaacagatggtacagagacaaagccggatgatacgaaaccagataaatatgaaattaccattgtccatatgttttataaaaacgatggaaaaacaaaagcagacaaagcagatgaaaaagagacagtaactgttgcaaaggatgcgaaaacggtgtcatctgcaaaaacatatgacggatataaagcttccaacggtacaacccttacgattcaggatggtgcaaaagaatataccatcatgtgggttgcaacagcagcagataaggctacttataaggtaacacataatttctttcaggctgatggaaagaccaaagcagaagaatccaaaagtgaagatatcacagtagatgctactgctactgagatacaggcatcttcttatgaggcacagggatataaactggcagaaggttccacgaagatcaaagtggcagcaggcacaacagcatacacactaaaatgggtaaaagctgcagccgcagccagcgcatccgtcacagcaccacagacggcagctttatataacagcactattaataatgcaaatgcaattggtctcacagcaacattgacagacgcaggcaatattattacaaatattacatggacaagcagcaacgaaaaagttgtaaaggtatccaatggagcaaaaacaggatgtaccttaaccgcagttggaataggaagtgcaactgtaacaggtacgatcacatacttatccaaaccgggcgataccaagacaaccgcaaatgataaaaaaatcacatgtacagttaccgtgaatgattttaccggaaatacaacaacccagttaaaagataaatccggtagattactttacaaagattccgagtgtaaaaaaccagcaaccgtggcagattacaatgcaaacggaacttactacaccgagccggtttacaccggatggcagaccattgatggaaaagtatattactataacagcaaccatcagcgtgtaacaggaagtcaggtgatcagcggtatctcttacaacttcggaagtgatggagcattacagcagggttccggaaagaacggtattgatgtatccagccatcagggaaatatcgactgggcatctgtaaaggcagcaggtatcaattttgcaattatccgtgtcggttaccgcggatcacagacaggagcattggtagaggattcctgcttcaagaaaaatattcagggtgcaactgcaaacggcattaacgttggtgtttacttcttcacacaggctacaactgaggcagaggctgttgaggaggcaagtatggcattgaccttatgctccggatacaatctttcttacccgatttttgttgatacagagaacggaagcggagcagcccgtgccaacggattagataaaggcaccagaacagcatgcgtggctgcgttctgtaagaccattgcaaatggtggaagaaaagcaggtgtttacgcaagcaagagctggtacaacaataaaattgatgcatccgcattcagtaactactttatctgggttgcacagtacaacacaacctgcaattacaaaggaaaatataacatgtggcagtactcttccaagggaagtgttcctggaatcaagggaaatgtcgatgtaaatattgcatattaatttatgggttttaaaaggatgaccggtatctgttcagataccggttgttttgcgcataacaatcaataaggagaacaggtttgccatattataataagaaagagtatccaaaacagatatgggtgtcgcagataccggagcgtgaagtttctttgttaagagaaaatcttgcaggaataaaacaaactacgcttgtattaataaaaaaagaggaagcctttcatcagccgtcagagcagcggagcagagatatcatttttctatcttcgaatcagtctctgttagaccttgccagagatgtggatgtcccggcgattgcctatcagaagccggaaacggatacatttcttcatgccgatatggtcgtcgaggggttcgaggaagtcgatatgacgtttttacagcgtgtgtatgagagacatttcaacattccatggacgattctggagacggaacgctgtattgtgagagaactggaactttctgatctggatgaccttttttccatgtatgcagaacccggaatgaccgattatatggaggggctatatgaatatgaggaagagctggaatatcagaaagcctatatcgaaaatatgtatcgtttttacggatatggaatgtggctcgtttttgagaaaaaaacgggcacgctgatcggcagggctggtgtggaacaccgggaagagttaaatggagatatggaattgggttatgcgatccggacatcctttcaacatcagggttatgcctatgaagtctgtcaggcgatcatgcaatatgcaggagaggagctgcaggtacatctcttgcactgtctgattcaaaaagaaaatactctttctgaaaaacttgccataaaattaggcttttcatattgcggtgaccgggaaatagacggcgtcctgatgtcagattatcagatagaatggtgatggaagccggatgcaaagtttaagcgttgatttttgatagaaaataaaatataatcatatattatacacaaaagcatagataaagtgggtgatctacatggcagaactttcatcagaagaattagagaaaatcgtaaaagaagaggacaatagtattaaaccaatgaaggagtttgagagtcccgaaaaattatatcaggaattgatcgccagtgtccgtaagtatcatccatctacggatatcagtctgatagagaaggcatacaatattgcatacgaggcacataaggggcaggtaagaaaatcgggagaaccgtatatcatccatccattgtgcgttgcgattattttagcagagttagagcttgataaggagacgatcgtagcgggacttttgcatgatgtggtggaagataccgttatgaccgacgaggagatcaaacaggagtttggtgcagaggttgcactgctggtagatggtgtcacaaaattagggcagttgtcctacgatgcggataaggtggaagttcaggcagagaatttaagaaaaatgttccttgccatggcaaaggatatccgtgtgatcctgatcaaactggcagaccgcctgcataatatgcggacactgaaatacatgacgccggagaaacagaaggaaaaagcgcgcgagacaatggatatctatgcgccgatcgcccagcgtcttggtatttccaaaattaagatcgaattagacgatctgtctttaaaatatttagagccggaagcatactatgatctggttcatcagatcgcccagagaaaaagtgtcagggatgattatgtccagagccttgtggaagaggtaaaaaaacatatccacgaagccggaattccggcgcagatcgatgggcgggcaaagcactttttcagtatttataagaaaatgaagaatcaggataaaacgctggatcagatttatgatctgtttgcaatccgtattatcgtggattccgtaaaagactgttatgcggcacttggtgtcatccatgagatgtataaaccgatccctggccggttcaaagattacattgccatgccaaaaccgaacatgtatcagtcacttcacacgacattgatcggaccgacaggacagccgttcgagatccagatccgtacctatgagatgcaccgcactgctgagtacggtatcgccgctcactggaaatacaaagaggcaagcaataatggcggtgctgcagcaccaatgaccgttaccgaggaagagaagttaagctggctgagacagattttagagtggcagagggatatgtccgataacaaggagtttatgagcctgttaaaaagtgatctcgacctgttttcggatacggttttctgcttcacaccgacaggagatgtaaaaaacctgccaaacggttctacgccaattgattttgcgtacagcatccattcggcggtcggaaacaaaatgatcggagccaaagtcaacggaaagcttgttccgattgattatgtgatccagaatggtgaccggatcgaggtgttgacttctcagaattccaagggaccaagccgcgactggctgaatattgtaaagagcacgcaggcaaagaataagatcaatcagtggttccgaagtgagttgaaggaagaaaatatcgtaagaggaaaagaactgcttgcatcctgttgtaaatcaaaggggatcaacctttccgatatcaacagaccagagtatcaggataaaatcatgcgcaagtatggttttcacgactggaattcctgccttgcaaccgttggtcatggcggtttaaaagaaggtcagatcgtgaaccgcatgtacgaggaatataagaaagaccaccttgcacgtattacagacgaggaagttcttgagacaatctccgaaaataaagaaaaagtcccggagaaaaaatcaaagagcggtatcattgtaaagggactttatgacgtggcagtccatttttcaaaatgctgcagtccggttccgggggacgagatcgtaggatttgtgacaagaggacgcggtgtttccattcaccggacagattgcatcaacatcatcaatctttcagatatggagagagaacgtctcatcgatgcagagtggcagcatgatgaagaatccggcaattccggtctttatctggcagagatcaaagtattctgcaataaccgtaccgggcttctcgtggatatcacaagagcctttacagagcgtgcgattgatatcaatgcgatccattccaagacgagtaagcagggaatcgcaaccattgatatttcatttaacacaaaaggaaaagcagagttgacgagcgtgatcgacaagcttcgtcagatagacagtattattgatattgagagaaccaccggctgatctggctcaggtggtttctttcatctttttatggaggaagaaaaagatggcaccattaagtatacagatatatgtagtaggtccggtacagaccaattgctattttgcgatcaatgatgacacaaaagaagtactgatcattgatccgggtgcaagtgcaaaacaacttgcagagaaagtgaaagagcagggattgaaacctgtggcaattcttctgacacatggacattttgaccatgcgacaggggcaggggagctggcgcagcttttgcatataaaaatatacgcgcaggaaaaagaaaaagagacactggaaaatccgcagttgaatctgagcggatggcagggaagcgagcttgtgttctatgccgatgaatatttaaaagatgagcaggaaatagatcttgcaggatttcatatacgggtatttttaacaccgggacatacggtgggaggctgctgctattattttccttatcagaacacgttattcagcggagacagcctcttccagacttctattggaaggactgatttcccgaagggaagtgcttcccagctgatccatgcgatccgggaaaaactcatgccgcttcctgatgagaccgccgtgtatacagggcatggagatatgacaacgatcggaacagagcggatgtacaatccatatttataacagactgactatgaaaaaatatcgtctgtaaagaagactttcatcaaaataggaaacacagccagaaaaggaaaacaatatgatattagcaaagttaagcaagccggaatttgagtatgatatccattccctcatcaaggcatttttcccggaggaaaatgtgagtgcaacggcagaagataaaaaatatgaggaagagatcaccttacagtttcaggtggagtatgagccacagcagataaaaattgagtggaaggaaaatggtcaggaaagtcatgaccgaagttttccggtagatttttcagaccgcacggaaacgaaaaacgaactgaaacagaatttttatcagatattatcagagatcacgggcaaaaagcttccgtggggaacgctgacaggaatccggccaacgaaaatcccgatgaaatttttagaggaaggaaaaacggaggaagagatcagaacctacatgcaaaaaacgtactttgcatccgatgagaaaatcgatctttccattgatatcgcagagcgtgagcttgaaatcttaaaaaagatcgattacgagaacggctacagtctttatatcggaatcccattctgtccgacaacctgcctgtattgttcatttacatcctacccattagtgagctggagacagaaagtggacagctatctggatgccttggaaaaagaactggattatgttgcagtaaaatttggaaaaaaacatctgaattccatctacattggagggggcacaccgacaacactggagccatatcagcttgaccggctgatccgtaaaatccgatgcagctttgatctgtcacactgtctggagtttacagtggaagccggacgtccggacagcatcacaagagaaaaattagaaacgttgaaaaaatgggacatcacaagaatttccatcaatccgcagacgatgaaggatgagacattaaaaatcatcgggcgcagacataccgtggcacagaccgtggagagttttcagcttgcgagagagcttggattcgatgatatcaacatggatcttatcatgggactgccggaggaaagccttgaggatgtcagggataccttagagcaggtaaaagcgttaaaaccggataatcttaccgtgcattcccttgcattaaagagagcggcacgccttaacatgtttaaggaagattataaagattacaagatggtcaacaccacagagcatatgaacctcaccgcagaatatgcaaaggagatggggttagaaccatattatctgtatcggcagaagagcatggctggcaatctggaaaatgtcggttacgcaagtccggggaaagcaggaatttataacattctgatcatggaggagaaacagaccatcgtggcgtgtggagcgggagcttcaacgaaacgtgtctggacagaaccagatccggacggcactcatcggatcgaaagatgcgagaatgtcaaggatgtagcgcagtatatcgcaaggattgatgagatgattgagcggaagcagaaactttttgcagaagaataaaagggtttttcttcctgaaatagtacatcaagatgtattgaaacaagctaataactgtgccttaaaggacgaattcattttagaagatgagttcgtccttttctcatatattccaaaatgacggtagaactgttcacaagttttatggtaaaatttgaatacaaattgagcaacaaatctgggaaaacataatcatcaatgtgtaaaatgtgatagtcatgaggaaaaaacgagagtcacagaaaggatgtgggaggcattgtgcgggaagagaatcaaacaaccagtagccttggctgtattatttgttctaatgtttattggtggatgtttttttgtgaaagccaatcaggcaaaggaatttgagaaaaacgattatggggtgtttttaaatgcggacgcctcatctttggaacgatttaaaatgtatgaaacgattgtaattgatgcacagtattttacaaaaagggatattgaattgctccatcaaaatggaacagtcgtatatacatatctaaatattgggtcgattgaaaacttcagggagtactatacaacctatgcggaactggcaatcggtgagtatgagcattgggaggaagaacaatgggtggatgtagcaaacccagactggcagaagtttataggacagctttctcaggaactatatgaaaaaggtgttgatgggttctttatagataattgtgatgtatattattacgctccacgcgagagtatttttgaaggtcttacagctattctgcaaaatattatgatgtttgagaaagcggtcatcatcaatggaggagatacttacgtggcagaatatagagaacgctatgatgatattactcctattatgacaggcgtaaatcaggaatccgtatggagcggcatcgattttgataaaggaacatttcatgagcaaatgagcgagacgagggattatttctgcaaatatttggaagcgtgcaaagcagatggaatggaagtatatctgttggaatatacaacgaacccaaaactaatccaaaaaataaaagaatactgcaaggagcaagacttccatttttatatttccagttcccttgaacttagataataagtgctgggaaatacgaaaagtatgcggttgctttttctggaacgggataatgttattactattatttgattgacaaaaattagataggttttataattgatattaagaattgttcctaataacgagttggatagaaacaactaaaaaatagaagaaaaggggtaagattatgtttgagatgaaaccagagtattacattggaataaaaatgattgatgaacaacataaacagttgtttacatatgcggatgaagcatatagcagattatgaagattttgacataccttacggaatggttagtaaatcatattttgtatgttgatggacagattccacaggaatgatgtcatatataggagtttatgaaagagatttatggatgaaaaacagttaagcatagatatcgttggtttggcaggaggttcctttatttgcaaggattattcatcttgcggatgtaatagatgcgattgctaacaacataaaatgtagacaggaaaaatgggataaatgttgtgaatttcttgtaaaacaaaaaggattattatttgatgatgagtgtgtagaagccttttttgaaatgatatcaaaagaaacatttgtttcgttagaggatggatcttttgagtcaaagttatgggagatcgttccaagaaaaaaacagatgtttgattggaatacttgtaaaaatattgcagatttctttgcgaatattgttgattataaatctccctttacaagtagacactctattggtgttgcagaaaaggctgcgcagtttgcaaagtatattggatatgatgttttagatatcgaaaaaatgtatctggcgggagcattgcatgatatcggaaaaatggcggtcggtaatgaaatattagaaaaaccggataaacttacggatgaagaatttgataaaatgaaaaaccatgcgggctacacatatcttatgttgtcacaagtagatggttttgaagatatacgggattgggctgcactacatcatgaaaaactaaatgggaaagggtatccatttggaaaaactgcagatgaattaaatgaacaagaacgaattatggcatgtgttgatatttatcaggcgcttacggaagaacgtccatataagaaaggaatgtcgcatgaaaaaacatgtgatatacttgatgaaatggcagaaaaaggttttgtggatgcagatatttcacgtaaaatgagagattgttttcattagcatagtatgaatgttacagaaaaacgggtagccattaactcattggtatagtttgcgacgggagcaaattcattcatgatgcccttatagatttcagcagggatggtccaaagatcagtatctttctctgcttgtcgaaagtgatggatggaatgtataatattgttaatgattcagagatatttattttggaaacaacttaatcaatttggaggtataaaatgaaagcacataagtattggtcaatcggagcgttaattactatgattgggactttttatactggatataaaggatccaaatcaggtcataggtattttgcatgcagcactcttatatgtatgatcatgtccatgtatacgggacataaaatgatttcagttaataagagagtaagaaaacaggtggaaaatacagaagcggaggaatagtaaatgttagagtcaggaaccaaagcaccggactttgaattgccggatcagaacggagaagtgcataaattaagtgattatttaggtaaaaaagtaattttatatttttatccaaaggataacacggcaggctgtacaaaacaggcatgtggtttttcagagcgttatcctcaatttaccgagaaaggtgcagtgatccttggagtcagtaaggattctgtagcctctcacaagagatttgaagaaaaatatggactggcttttacgctattagcagatccggagcgtaaagttattgaagcatatgatgtctggaaagaaaagaaaaactatggaaaagtatctatgggcgtagtgagaactacatatcttatcgatgagcagggaattatcatcaaagccaatgataaagtcaaagcagcagatgatcctgaaaagatgcttaaggaattagagtgatgaagattatattatcacctgcaaagaagatgattgcagatactgataacttagcaccggttgaactgcctgtctatattgataagacagcagaagtattaaactggatgaaaagcaaatcaaaagaagaactgaaagctatctggaaatgtaatgacaagattgcagagcagaactttaacagattggaaaatatggatctttataacaggcttactccggctgttttagcatatgaagggattgcatttcaatatatggcaccatctgtgtttgaaatccagcagtttgagtatttgcaaaatcatttaagaatcttgtctgcgttttatggtattttaaaaccaatggatggtgtgactccttatcgtcttgaaatgcaggcaaaggttggaattggagatgcaaaaaatctgtatgagtactggggagaattgttataccgctcagtaatcgatgacagtaggattatcattaatcttgcatcaaaagaatactcaaaatgtatagaaaagtatctgacaccacaggacagatatattacgatagtattttgtgagttagccggagataaattggtaacaaaaggtacctatgccaagatggctcgtggtgaaatggtcagattcatagcagaaaataatattgaaaatccggtggagattcagaaatttgacagactcggatattcgttcaggtctgatttatcttcagattcagaatatgtatttgaacgcaaaataaaatagtgattcagataaaagatgcttggtttggcatcttttataataatgagaactattactattttcattgataataggataatagaggtaaacaatcttaatttagaaacaatcctaataaggaggacgaatgacaagtaggagaaataccattcaaaaagatcttgtaagaaatgccgtatacgaaatgagaagacacgttacagcaaatgaagtgtatgaatttgtaaaagaagcatatcctacaatcggaaaaggaactgtatatagaaatcttgatatattggtagaggaaggtgcattaagaaaggttgaagttccggatggaccgaaccgatttgattttacattgaaaaatcattaccatgtaagatgtataaagtgcggtgaaatttttgatgtggatatggatcaaataccggatttgctggaaagaattcataacactcatggaattgagtttttggattatgatatttcatttaaaggcatctgcccgaaatgcagggagaaggtaaaggagaaacagcatggataggaaagcaatgtataagttaaggtatgggaatgccgtaactgcggagaacctatgcaggaattaaaagccggagtgacagatgctgctgttgagaagcatgtacctgtatatacagtggaaggcagtcatgttcatgccgtggtcggagagacaaaacatccaatgcttgaagaacatttcattgagtggattacattaaataccaatcagggaatatacagaaaacagttaaatccagggcaggagccggtagcagatttttgtctttgcgatggtgaacaggtagaagaagtatatgcatattgtaacctgcatggattatggaaatgctaaaagcatttatacatattaagattaaagaacaacacaaatataacagtaatataggttgtgtattaatatatttacaaggatatttccggttccttttttagaatgggaagcggagaaacagtagagaggagaatactacattccttgataactgaatatacaaatgcatacaggacgtgacgtgcggagccggaaatgtcaccaagagagtttatgtggacggtagaatcgtatacctgatatcttggagacagatgaaaggattgaaatgcctgcaaaagctgagatcagaaaaacatttatgataaattaaaaaatgaaaaagacattcttccataaatcttaaagaatgctttaaaattatgtgttatagtgatacctgttaaaaagaaaaatttggcagacaacaaaagaaaagccagcagagatgaaaaggagatatcgattattatgaaaaaaagatatgcgttattattgacaggtttattaacattatcacttgcagcaggatgtggcgctaagactgacaatgcaggagagacttctgcaccggcggtttctgaatcacaggcagcagagagtacggagcagacagcagatgtacagaacacagcagatcagggagaggaaaagacgatcacaggaacaattgatgagatcaaagatttcatgtttgttatcacagatgagtctggcgcagcatatgaattcagctttgagacagcaccggaaggactggaaaatgtagctggtggagatactgtaaaggttacatatacaggtgaaatctcagaggttgatccatttaatggaactgttatttctgttgaaaagcagtaagattattcaattgaaaagaatgatgaaagagcgataccacagcgtaccgctcttttttttcggaaacgtaccgatttatacaaaatactttgacatgagttatatcaaaccgtataatagacaaggataagcaacgccagacacaggtctggctgtctgagatagatgaaaatggaggaaaaccaatggcgttgagcaagaagccggtaaacggcatgaaagatattttaccagaggaaatgcagattcgtgattatgtgcagcaggtgatcaaagagacataccggaatttcggttttacacagattgagaccccttgcatggagaacattgcaaatttaagcagcaagcagggtggtgagaacgagaagttaatttttaaagtaatgaagcgtggcgagaagctaaagatcgcagaggcaaaggatgaaacagatttagtggattttggaatgcgttatgatttgacggttccattggttcgttattattcgaacaatgccaatgatctcccatctccgtttaaggcgttacagatgggaaatgtgtggcgtgcagacagaccgcagcgcggacgttaccgtcagtttatgcagtgtgacattgatattatcggagaaccgagtaatctcgcagagatagaactgattcttgcaacaactacaacgatcggaaaattaggatttaaaaattttgagatccgtatcaatgagagacgtattttgaaagcaatggctgcctacagtggttttgcagaggaagattacgataccgtattcattatccttgataaaatggacaagatcggtcttgatggtgttgcagaagaacttgcaaaggaaggttatgcaaaagaatccatcgacaagtatctcggacttttcaggggagtggaggaagcaggaaacggaatcgatggaatctgttatatcgcaaagactctggaaggctttttagaggaagacgttgagaaaaacttattagagatcattaacagtgtcaacgctgcaaaacaggcagatttcaaactggtctttgatccgactctcgttcgcggcatgagctactataccggaacgatttttgagatcgcgatgccggagcttggcgcagcctgcggcggcggtggacgttacgataagatggttggcaaattcacaggacaggatgtaccgtcctgtggattttccattggttttgaacgtattgtactcttattgatggagagcggatttacagttccgatgcagcgtccgaaagttgcatatctcatcgagaaaggctatccggcagacaagctcgtcgatgtgatcgcaaaagcgcaggaggagcgtcaggctggcaaacaggtattagttgtccgcatgaacaagaacaagaagttccagaaggaaaaacttgcagcggaaggctataaggatattgtggaattttttaataactagataattcagaatggaaacgctatagcaaaaactatggcgtttttctttctattgcgagaaaaaacgttgaaaaatagcacttcatggtgtaagattaaaaaagtgtcaaagcaggatttgctgcaatgataaacttataaagacaggcagtctggacagcctgaatgatacaaaggctatttaacgtcccgattgctgtaaggaataaaaaacaaggagttaagaaaatgattcagtcaagaactcataattgtaacgagttacgtctttccgatgcaggtaaaaacgtaacaatcgttggatggtatgagaacatccgtaaagtaagtaaaaatcttggattcctgattcttcgtgatttctatggtacaactcaggttgtgatcgagaccgaagagatgatgcaggtgatcgacagtgtgaataaggagtctacgatctctgtgacaggtgtggtaagagagcgttccagcaagaacaaagaccttgcgaccggtgagatcgaagttgttccggagaagatcgaaattttgggaaaatgtatttacaatgcacttccatttgaaatcaaccagtccaaagatgcagatgagaacacaagattaaaataccgttatcttgatcttcgtaaccctgctgtcaaaggaaacattgtattgagaagtaagatcgttgccgaacttcgtcagaagatgaactccttaaacttcatggagatcacaacaccgatccttacctgttcttccccggaaggagcaagagattaccttgttcctgcaagaaatcatccgggaaaattctatgcactgccacaggcaccacagcagttcaaacagattttaatggcatccgggtttgaccgttatttccagatcgcaccatgcttccgtgatgaggatgcaagagcagaccgttctccgggagagttttatcagctggatatggagatggcatttgcttcccaggaggacgtattctcagttgtagaagaagtattgccacctgtatttgaaaaatatggtgtatacaagacagcatccaaagccccatttgtccgtattccatatctggagtctatggataagtatggaagtgataagccggatcttcgtattgaccttgtattacaggatacaacagaagttatggcagactgcggattcggaccatttgagggacagactgtaaaagcaatcgtagttgacggatttactgcgaccagaaaagtgatcgatggaatctgcgcagaagtagaagttcagactgcaaacaaagcattctggttcaaattagatgaaaatggagaacttgtcggaggaatcgcaaagttcttacaggacagaaaagaagccgtgatcgcagctcttggattaaaaccgggtgattttgttggtctgacagcaggcaaaaaattagccgcacagaaaacagcaggtgttctccgtaaacttctcggtgcagcaagcgataagcatatgaagaaagactgctacgagttctgctggatcgttgatttcccaatgtatgagatcggtgaggaatccggggaattagagttctgtcataatccattctctatgccacagggcggaatggacgcattaaacaatcaggatccattagatatcctggcataccagtatgaccttgtatgtaacggtgttgagctgtcctccggtgcagttcgtaaccatgatcctgagatcatgatcaaagcttttgagttagtgggacttggcgaggatgatgtgaaagcaaaattccctgccatgtacaatgcattctgttatggagcaccaccacatgccggtatcgctccgggtgtagaccgtatgatcatgctcatctgtggagaggaaagtatccgtgagattattccattcccaatgaacaaaaatgcaatggatatcatgatgggcgcacctgcaactgttgaacagaaacagttggatgatgtgcatattgcaatcaaaatgcctaaagaggattaaccggagtttaacttatgaactgccgcctgtaggtggtggcacggatttttagattgaattttataatttagattatgaacaaaatattgcagtctgacatgtttacgaaaacatgaatgtgaaatggacgaatattgtgtttcgttgcgttaaacattgcgatgaacctctctgatcatttgtgttcagcagaggcttccacaaatggagagtttcatctccataacgcaaaacgaaaacaatattcgtccattttacattcattatctcatgagttatgaaactgcaatattttgaatatacactccatagaaattcaatctcaaaatccgtcaatccatgttacgagcagcagtaatcatagtttaagctctgggaggtgtaccctttatcatcgatgaatcacaagacattgaaaatgactgcattttgtcgtcacctcctttataggcactcatccactaaccgtgagttccataacgtaaattgcagattctgtggtgcgattcataatgttgaccgggcatgtataagcgtcctctcacaagtcattcacagcgtaaatgaaagaaaaacggtataaacaaatattattttctttgtgagctatggagataagactctttagaggcttatcgaaatgcccggcgaacagaaacataatatttcgtttataccgtttttctttttcattaacatataaaattctgacttgtgagaggacgcttatatctgcccttcacaccctaagaaagcaccacaaaatctgcaattgatgttatggaactcacggttatggaataagtgcctatattgggttctgccgctcgtaattcagattgatggtttttcattgacacaattctaagattgctttatactaagcctacatcaaagtcgcagataaataacagttacgattatgaagcattcataatcgtgatcattcttaacaacgtttctgtctgcagattcaaaacctgatataaggtcgaggatatgacctcaaaattcattgtcggttcggcaggagattccattttgatgaacaattcaatgcagggagcatttgatctgactgatgtttttgcatacccacttatgtaaaaaacaacagaaaatccaccctatgcattgaaaaaaacacaatattctattatcataaaaggaggaataggattgaataccaacgatgaaaagatccagtggcatccggcatttgatgcggcactgcagattgagttcggagacgaagcaaaatatccggaatttgatccggaacatctcatctcaaaaaagccaatgcagatcgatgtgctggtcaaaaatgaaaaacacgtaaaactcagaaagaatatcgggaggatcttccggcagtataatatcatagagtacaaatcaccggaagacgaccttgacattgatgatttttacaagacctatgcatacgcctgtctttacaaatcagatacggagacagtagatctgatcccggcagatgaactgacaatcacttttgtatgctatcattatccaaggaatatgctccgcaaattggaacaagaccggaagttttcagtggaacagcaggacagcggcatatactacctcatcggggatgccatcccgatacagcttgtcatagttccgaagctgtcaaaggagcataactactggctcaataatttaaggaatgaccttaaggcgggcagtgagattaaaaattttatagaaagttacagtaaaaacaaaaactcaaagctatatcaggcactcgcagacgcagtcatgcgtgcaaactgggaaaagttgaaggagggatcgaatatgtgtgaggcattaaaagaattgtttgcggacgactttaaggaatcggaattgaaaggcagaaatgccggcaggactgaaggcgcggcttctaaaattatagagaaggttattaaaaagcatcaaaaaggatacaccgccgaagccacagcagacatgttagaagaacctgtctcccggattcggcagatctatgacgtcatagagaaaagctcgccggattatgacgcagagaccatatacaaacagctccatgaaaaagaagaataagcttttggtgattgtggtagaatttgatcagtaacgaattcaatcggaatgtgacaaaggaatgtgatgatatgaaaaaaacgataggtatgacagccttgctgtttttgatgatggggttgatcggctgcaacggagaaacagccaatattgactttccttttgaagttggagatattgaaaatattgaaatgtatcactatgcaggagtacctacatcagcggaaaagaaagtagtagttgcagaaactgacataacagacttatatgatatgtttgagaacttatcattgaaagaaaaacaagttgaggaaaacacaggagcagatgtaaccagttttcgctttaacctttcagatgggacaagctatgaactgatttatgtctgtgatggggtcaagaacggaaagctgaaatcttccactggcaattttgaatactttacaagatcagatattggttcatattggttcaataatgaacttgaagcagtcccggttgaagaaagcgaattgccgatgcagaccaattaaatccatcccataacaggcactcctcccctaaccgtgagttccataacgtaaattgcagattttgtggtgcgattcataacattgattgggcatgtataagcgtcctctcacaagtcattcacagcgtaaatgaaagaaaaacggtataaacaaatattattttctttgtgagctatggagataagactctttagaggcttatcggaatgtccagcgaacagaaacataatatttcatttataccgtttttctttttcattaacatataaaattctgacttgtgaaaggacgcttatatctgcccttcaaactctaggaaagcaccacaaaatctgctgctccacggtaagttaaactccggttttgggacgtatccctgaatggatagcgccggttggacagacatctttgcattttccacagcggatacattccgcactgtttggattttcataaaccttgacacccatatcacatttctttgcacaaagtccgcatttcgtacatttggtggcatcaatctcgtaatggtagagtgaaaaccggttgaaaataccataaatcgcaccaagtggacataaatacttgcagaatgggcggtatatcattgtagataaaataagaagaatgacaaggatgctgaccttccacccaaataaaaagccgatggcacgctgaagtcccggattttttgcaacaagcggaataccgccgagcagtgtgccggacggacagatcagcttgcagaaccatggacttccatagccgctttccccgacaagaagcaaaggcatggcaatgacgaacacaacaaggatgacatattttaaatagcgcagatagcggtcaaatgggacttttttgatctttttgacaaaagggatcttatgcagcagatcctgcacaagaccaaaagggcagagccagccgcagacaaaacgtcccatgagagagccgaagatcattaaaaatccaatgacataaaaggaaaatttataatttttactgccgagtacagcctgaagggatccaatcggacaggaaccgatagcacccgggcaggagtagcagtttaagcctgggacacagagctttttgcttgtgccgcggtaaatttttccctcggtaaaaccgatgacatatccatttgtcagggcggtgaaaagaacctgtacccataagcgtaaatgttttcgctgtttttttatccagttcatgatgaaaaacctttccttgtaaattcgtgtaatgtattttctattatccgatgccaatgcattccagacagataatatttgacttattctgtacagtggtatgctcatttcgatggattccatttaaaataaataaaaccccgatagctaaaagtaagatgcctgtgacagagcgttttttgatattcatataagtttcgcctcgtttcgtgagttccggcagtccgggaaactgccggaaacctgatctatatgtgactattctgctaagtaagagtcaatgagagctttccagccttcatagtccttagaaccttcgattgtgtcaaggatggtcccatctgatccaactacataagtggtagggtatgccataatatttaaaagggattcatttgtggcaagcgttccatccatacgaagctgtgtgtaagatgcatttgcgttactcataatatctttgatctgagccatttcgtcatctgagatacccatgccaagatcaccgtaaagtccgtaaacagcagcacctttgtccttgtattcactattgatcttatcaagatcaggaatttcattgacacatggggtacatccgacattccatacatttacaagtgttactttgtttttggcaaaaatagaggaatccattttattaccatctatatctgtagtatccatgttcgtgaaaatatcatttgtggaagcagtgctgtcggaagcagtctgtgcagtgctgtctgtctgttcagttgtagctgtttcctgtccggctgttgtggaagaagtattgccggtggtgtttccggtctgtccgcatcctgcaaaaagaagtgcgcctgtaagtaaaagtgttgcgatagataatgttttgtttttcataataagaaaatctcctttgttttttgttgtgcagactattgtctgattgatttgatagacatatcataacgttccaatgtgaaattaatatgaaatcagaaaatttttttgttgataatctttagaggtcataataaactgaaagtagtgttattgttataggaaaatagcacattttaacagggaagtactaaattaaggaaaaggaaagtataaaatgaatattttaattgtagaggatgatacagcaatccgcgagggcgtggcagagtttttaaaagaaaatgaatatgaggtcttttgtgcagaagatggggagaaggcgcttgaaattttaaaaagcaaagagatacatctggcattgctggacattatgctgccgaagaaaaatgggatcgaagtgttaaaagaactgcggacattcagtgaacttccggtgatcatgctgacggcggtcacggacgaggaaacgcaggtgcagacgtttgacaaccttgctgatgactacatatgtaagccgttttcactgatcttacttttgaagcggatcgaagcactattgcgggcacgttataagacggaaaatacatggaaatacaaagatgctgtggtggatttttccgggtatcgggcaacgtatcttggaaaagatgcggcagtcacaccgaaagaaatcaaacttttagcagttttgttagagaatgcggggcaggttgtgagccgggatcagattttagaccggatctggggtgaggaggaaagcccgtttgaccgtgttgtggatgtctatgtgaaaaatctgcggaaaaaactgcagctcgactgtattatcacggtgaagggcgtcggctataagctggagctgccataaactatcaataagtgatcagcctgcaagagaaggctgtattcagcggtgcgcacaggatagtgtcaaatgacctatgaaaaaactgagcaaaagaaaaaggctcagatgaaccttgaaaactgtagatcttttaggttgtggtagcccaccgccacccttgacggtacgaaaaagaactgctgtaggttaatcaccgacggcgaagaactcaagaacagttagagtttttccgtcgattacagcagtgtagcagttctttttcgtgccatcaagggcacaccgctttgcggtggctgggataattacctctggctctgaatctaagaacagttagcggcttcgccgtgttgcaggttcagaatcgtctgttgaccaaggaagatgagaagctgccatttgcccagcatcgtgtcagcctgagacagcatttcgacttcatttaagactttatagttgttgtgtttgtgtggtcttaggaagttgtaataagcaacccagagggcgagatcatagttggctccatcgatgttatcaaagccgttggttttacgataggaagctttgtatgtacggtttaagcgctcaatcatctgtttgtaaggcctgaattctttagaaacctcattgtcattggtgagtccgattacctgtgtgatttcaaacttaaacttatcaccgaattcatggaagaactgctgggcggcaaggggatatgcactgtagccatctgcaatgaacttaaagttcttaggcagttcttttagatgttggaatgccatccgcattgccagaatgcatgggccaacaccacgattatcagatacttgatagccgataacagagcgtttggcagcatccatgataaaccagatataggttttgataccacggattttgatgtatgtctcatcagcagtaaatacattgccagttttgtaatcgtagttgtctacgaaaggttttatgcagacagaggcggttttgcaatagttggcaacttgctggtgtgagatgctgatgccgtgtatgtccttcaacgcctgagcggttttacgaagcgataacccaagattcactttgtaggtaagacaaagtgacatgacatgctggtcatgtttactgaattttagggaagaagcattcttgggaagagtgtttaaatccatgcgaaagaaatctatctggaattcccggtagatgtaatggagtttatatttgttcttgccatagtcctccttaaggtcttttttatcaaccttgtttagattgtggaggtagtaaggacattttggatttacgcatttgtggacaacaaagtgtttgcggtctttcttatgagccagcgagtgattgcagtgcgggcatttgagggagtaggactttgaaaaacggttttcttccggagagaatgcggtggagcatactttgcacaggatctgtccttttgaaccattattcttgtagagataaggctttggagcattgcaacgtggacagctacagttgtcatcaatatcacattcagaacggcggctgacaggtttgattttcttgccatacttccattcgaggtaaggaatgtagtctttgtaatcccatttttcgtaatagattatttttgggagcttatcaatcttgaatttttgatatttgggagaatgggaatcatcgaagacccactgcttaaggggaatatatctgcagataaaattaaaaagccagcagatttgtttatgttggtattgaataaatagaagtaaataaagtataatgtccatgagcattgtctccttgttgataatggtgtttgtggtgaactcattatacttcttttgggaggtcaatgctctttttatttgcaaacctccaataaatcaaggttttaaaagaattttagaacaataaaatgggtagtttttgacactaccgcgcacagagtaggggattgaatatgaagaaaatgaaattatttcctaaaacatttttatatacgttttttatgctgctttttatcacaacatccatgcatctgatgatttattttttctatccgaaggtgtacttaagccggatgcaggatcagctggaaaagaaaatggacacattgcagcaggagataaaaaggaatactgcagcggaagcagggcagattttttctgattttgcaaaacaaaataatgtcaatgttacggtagagtgtgccggcagtgaagttacttatatgggaatggatttccagatatcactgtataccgatgccgatatggtttttgatgtgagcaatctggaaaatgcggaatcgattattgtgaaaaataaaacaatggaagcagacgatgggattgaaatccaggtggaagtgatggcaagtgccatgccggtgaaagaggcagtggatatgatcacatttttattgccgtttacgttcggagcagccattctcttttccattgttttttcttatttatattcgagacgcattacaggacctatttttcacatgctgaatgtcacgaacgatatgaaaaatttaaaaccggaagcagcatttcatgtgcaggatgaagatgaggtcggacttctggcagagcagatcaatcaggtttatgagcagctgcttgcaacgatcaggagtctggatgaagaaaaagagcatatgctcgcagtggaaaagtcgaagactgtttttctgcgttcagcttcccatgaactgaaaacaccgctttccggactgcggatcctgctggaaaatatgcagtataatataggaaagtacaaggatcgtgacaaatatcttgcggaagcagttgccaaagtggatgagctgagcggaatggtcagggatattttagatacttccaaagtgcaggatctgcaggaagaagaaaaacagaaactttgtgcaggcggggaaattggagcagtgctgcaggaatatgcgatgcagatcgctgacaaaaagttggaggtgacagacagtatcccggaagactgcatgctgtttatgagccggaatacatttcagaaagtgtggtcgaacctgatcggcaatgcggtacagtacacagagcagggcgggcagatcacaattgacgcagacacagacaaaatctggatcgaaaacagctgtacaccgttgacagaggagcagttagcttatatttatgagccgttttaccgtgtggacgatacgcgggcagcttccgggggcaacggactgggactttatgtggtgtgggaactgctgaaaaaagaaggattccgctatgtatttgagcctgtggaagatggcatgcgctttacgattttcctatagacaaaaactatggattccaaaataaaatttacttgttatttataagaaacaggagtaaattgattcgtggtggtaaaagacatagatatatgatggcatgtaagaggcaccagaaagtcatggaaagggattcatagaaaatgagtgggaatacaaaagaagagacagaacagcaatttgtaagcgaagcaccagtggaagaggaaaatgggaaaaaacgaacggttttccgtggagaactggcgctttttatcacggtgatgatcaacagttttggtgtggtattaatgttatattccggtgcgggaatttccgcaatctccagtgtgccatttgcattttcagaggtggcgccggtcatttcactgggtacatggacgtatatttttcaggcagcactgatcttaagtctgatgatcatgcgcaaaaaatttgttccggcatatctgttcagctttgtggtcggatttgcattcagcgagcttttggatttgcatgaagcgtggattgatattctgccaaaatctcttggattttgcgtattgtattttgttatcagttatctgctgctgtgcattggcattgcgttttctaaccgctgtggactgccgatcattccgacggacttgtttccgagagaattatcacagatcacaggcgtgcgttattccagagtcaaaataggttatgatgttatctgcctgtgtgtgacagcagttcttaccggctgctttttgggacatttagatggacttggcattggaacagtgctggcagcatttaccatgggaaaagtgatcggaatgatcggaaactggatggatcagagatttcagtttgtatcggttctgactgcaaaatcataaattatccagaaatttcctcggatattaagaaaaaattcattagaaaaagggaacaatctatagtataatgttgctcacatcacaatggattgtgaaaatgaatttttgggcgtctgcgcacgccggaatgagagggaatatgaagagaaaaatagcatggattctgctggcggcaatgacactttccattgctgcgtgtggaaataaaaccggagattcggttgcagatgatggaaatatcactgcagaggcaacagagggtgaactggatacatcggcaaatctggagggaagctgtgcagacattctggatgagatttataaaacagcaaaaacagatgacgattacttcagctacacagatgattttgaaaacgtggagattaccgaagcagaagaagaatatattttaggaacgacagagattgattatacggattccgtgtactctgcgccgatgatgtcctcgattgcttaccagtgtgtattgctccgggtaagtgaagatcaggatatcgaagctgccaagaagcttttagaggaaaatgccgatccggcaaagtggatatgtgttgaagcagagagcgttgttgtggaaaacgttggcaacgtgattttattcatcatggcagacaaagatgttgcagatgcagcaaaagaagcgtttttagcgttaaaaaaataaatacagaaggtggtgcgaagcttgcttttttcaagtattacgtttttatactattttttaccggcggtattagtgatctattatctgacaccggcaaaagtgaaaaatctgatactgtttctggcaagcttcgttttttatttgtggggggagccaaaatacagtgtgctgctccttttttctgttgcagtcggctatatgggtggaagatgcatcgaatatcagaggcagaagaagtgtgtcagtgctgctgatccggcagacagatccggaaaatacaagggtggacatgacaggcttgtggtcgggatttttacggcaatgacattgggattgctggtattttttaaatatatggattttctggcagacagtgtaaataggattctcggtacacatgttccgatggtgcagatcgcacttccggtcggcatcagtttttacacgtttcagatcatcagttattatgtggatgtttaccggggagaggttgcggcagaacacaattttgttgattttgcggcatatgtgacgatgtttccacagttgatcgccggaccgatcgtccgctttcaatccgtgcaggcggaattaaaacaccgggagatcacatgggaaaacaccggggacggtgcggcaaggtttgtctgtggtctttgtaaaaaggttttgattgcagattcccttgcgtcgcttgtctcggcgctgcaaaatatatcagaaacagcagcaaaaacggaagcggtcgtgacaacaggaattcgtgcggaaggcgcagggatcggcacactgggttactgggtgcttgcccttgcgtttatgttacagctttactatgatttctccggttacagcgatatggcaatcggactcggaaaaatattaggttttacgttcccggagaatttcaggtatccttttatctcaaaaagtatctcggagttctggcgcagatggcacatgacgctgggcggttggttccgcgattacctttatatcccactgggcggcaaccgggtgagcgttctgcgatggtgttttaatatgttcgttgtctggctgctcagtgggctgtggcacggtgcaggatggaattttgcgctgtggggattgtattttggcgtattcttaagtgcagagaaattaatcggaaaaaaatggaaagaaagatcctttaaaatagcagacgtatccgcaaataatgacagtaatggtggtaacaggaaaaatatgtttctgatctgtgccagaaacagcatagaacatggttatgttcttctggtcgtcctttttagttttgtcattttccgcgtggagggtgtccgtgagataaaagaacagtttttaggattatccggatgttacggaaatgtaatgacaccgatggctgcttatgagataaagagctgtctgatacttttactcatcgcatgcgccggtgcgacaccgtttcctgcaatgtgggttcagagattaaaaaatacaaacatgtggaaaaagtcaggatggctgttacagagctgttatatactgacaggactggtgcttgctacggcatttttgttgggaagttcggtacatccgtttttatatttccggttttagagagagtgagtgggaaaccacattcatctgacaccggatcgttaatgaggagggcagaagcatggattggaagaaaaaaatagcagcagttgtttttctgctctcacttgtctgtgtcccggtggcggcgtttctgctgccggatcaggcggtttctaagacggagagacggaaacttgcgaagaaaccggcatttacagtggctgctttttgggatggaacgtatatggagcagttggaaacgtatttttccgagcagtttccggtgcgggacggattgcgcacagtgaaagcggagacggagacggcacttttgggaaaagcggataccaatggctattttaaggtggaggatggcatttatcatctggaggcagaattaaatgaaaagaatgtgggcagagtggcagattccatagagaagctctgcacagaacaatttcagaacgcagattgttatgtcgcagtcatcccggacaaaaattattatctggcagataaacagtatccaatactggattatgcaaggctggatgagatgatacaggcggagattccttcggtacagaaaattaatttatatgataaactgcatctggaagattattaccgcacggatctgcactggaaacaggaaaagattacggatgtagtagatacgcttgtgcagtctatgggacagcagaccaatacaatatctgacggctggcagatcgccacggagaattttgtcggagcttacggggcagcctctgcattgaaaacaacaccggataagatgatttaccggacagatccgtccgtagagcggatgcaggtctatgattatgaaagaaaacagtacgtaagtgtctatgcaccggaaaaaatcggtgggatggatgattatgatttttacctgtggggtgcaagagcgcttctgaccattcagaatccggagtgccataatggaaagaagctgttgctgtttagggattcttttggcagcagtatcgcaccgcttttagcggagtattatgagaaagtaacgctggttgacctccggtatgtctcagcttcgcatgcgctggagcttttaggagacacggaatatcaggatgtgttgtttttgtacagtgcaccgattttgaatcatggagacagcttgagatttggttagtgtatttaaaaataggtataaatgtattttttacggcataaaattataagggaaagttctattgactttccggtttgtacttgctagaatgtaagtacaaagaaagtttaccactgaccgatatgtggtatagaaatggtcgggttgaaagtttaccgctgaccaatatgcggtatagaaaaggttgggttgaaagtttagcccttcgccgtaaggcggagggctttttctataatggagatagaaataggtatgaaaaaaacgggtttttatattataaaggatcaattttttgaagaaatgtctgatccgtatctgaaaggcaataaagccggaaacagaccgcattattactgttttgaagatgcaagcacagggatatattggatgataccattgtccagtcgtattgataaatataagagtataatggagaagaaagcaaaagctggaaagccttgtgatattgtacatattgttaagttggatgacagccgggaaagtgcatttttgatacaggatatgtttccgataacagaggaatatatagaacgggaatatacgatcgctggcaatcatctgatgctgaccagtgagcacacagtaaatgaaattgctcagaaagcaagaaaagttatgggaatgttaaaacgtggcataaaatttacaccaacgcagcctgatgttttaactatattagaaaaattgaagaagcagagataaaaaagtccgcagccttaaaaataaggtgcggattttttgaatttcaaaaaatcctgtaaccaattcaatgtatttgcgtctttcctgataaagggaaatatgagaaaatagaatagaccagtgtaaaagcagcgggagaacatgaggatacgtgcaatggaagatgaaaagattattgaattatattggaatagagatcagggtgcaatcagacacacggcagagaaatacggcagttattgtggcaggattgcgaaaaatattcttttgaataaagaagattgtgaagaatgtgtcaatgacacctggctgagggcgtggaacgctatgccggacgagagaccggcaattttatctgcgtttttaggcgcaatcacaagaaatttaagtctggaccgataccggaaactgcatacggcaaaaagaggaaaaggggaagtggagtttatttttgatgaactgacagatcaggtggacaaaaaagagccgtcgcactacatagaggaacaggaattagtggcgtgtatcaatcatttcctcaaaaatctcccgaaggagcaccgcgtgatgtttgtgcggagatactggtattttgatagcattacagagattgcagagcgctgtgcatacagtgaggcaaaggtgaagacaacactttttcgtgtcaggggtaaattgctggactatctgaaaaaggagggctatgcattatgaaaaagacggactggatagatgtgatcggaaaaatcgatccggcttatgtaaaagaagcggaacagtggagcaaagcagcacagaaaaagagaaatcttaagcatttcaccgcaatggcagcgtgcgtgtgtattctgctggctggagcagtggtatcatttgatctgtgggtgcagaacaaagatacaggcgcagagacagaaagtgctgtcgcagaagggatgaacgaaggtgcatcagccccaaatgaggggaacgaaactgcagtggcaaaggcggaagaggaacagacagagagtgtggagtcagaatcttttgcagatacagacgagcagatcacgatcaacgaggtcagtgaactgacaacgattgcgatcgatgtggggaatggacaggaagagcgtatgagtgcagaggagttggagcagtattatggagtgacagtttttcccaaaaatctgccggaaaatcttgtggcatatgcagaggagcatgatacagatacagcctatgtacaaagcagtatacagccattggacggggaaaaagagaaaaatcagaccacggctgaaagaagtatttattataataaagatcatcaggtagtggatgataataatacatttctgtatgagagtgaggatggaaacagaagccttgagatcggtgtccgcacgatggaatccgggatcatcacggaatttgaggatgatgatttaaaaacttctgagatcaataatagggaagtgacgatcgcacgtcttgcagcggaggatgaatgttatctcgcgatttttacaaaggaaggtgtgacgtttaccatccagacgaagaatctgaccgaggaggaactcctcatggtattgcgtgaactgtgttgacctcaaaggggaaaaacgactggaagtaaaaaaataaaatttccgtgtaacatttttcaaaaaggattgttatatagatgaagttccaaaagcgcaggctgagtcacaggaatggggacggtcgtttttatacgggagaggaggagtcatggaaaaagatatattaaagcagctatatcagaaatatcgcaaagaaatatatctttacctctactctttgtgcaaaaacagcagtcttgcggaggatcttttgcaggaaacttttttaaaagcactgctttcgctgccggatgaccacacaaacatgcgtgcatggctgtatctggtggcgcgcaatctttttttcaattattaccgcagggaaaaagagaaagtaccgcttggtgaagtgcaacagatacagaataccgcatcgcaggaggttctggaaggcattttgaaagaggagaaaaacaggctcctttatcaggcaatgaatgaactggaagaacggaaacgggagattctgctgatgcagtattttggcggactgtcacagaaagagattgcggcgatcttaaaaatgacaccggaaaatgtacgggtactgtcatatcgggcaaagcgtgaactgcggacttacatggaggatcataactatgacttatcgtgaattgttaaaattatatcaggaaggaaaattagacaaggcacagacagatgaagtggaacatgccattgagaagcaggaagctatcagtgagtacctctatgaaaaagaggagattccgggactcgaagtacttcaagggcaggagaaagaagaggtttttgtgcagggcaatgatgcagaatccgaagaggaacagcgttttgtaaaaatgatacagaaaacgatccggcgaacttttttgaaaatgggtgtgatcgtcggaacaggcgtgcttgccgtcgtgctctgtgtgatctttgttctgccgcaggttgtatcggctttttactataatccaaatgaagtggtgggaataggcgaaggcagtgatattacaacaacacggatgagccttgacctttctgtatattccgaactgttctggccgggcagttaccggaacacagtcaatgcggtggcagagggttatggaacatacaatatttctattccgcaggggatttcatttggcggaaaatttacaaccgtcaacggcaggctaaagcgtgggaagctgacgctttataatacagatgagttcaaaatgccttatggaaatacgtttatggtgccggaagaggtggaagaatactctagaatacattttttcgacgaagataccagacaattctggggaccggcaggaagtgaggaggaagcatatgcgtctattgagaaactggatgataatgcgtattacattgcatacgcgtccctggaaaaactgaccagttatgcagatttttataattgggcgaaaaacagggagatggacgcacagctgtggtgtgcagtctatacatccgatgaagatggctatatgtgtgactctgtaccggttgggatgctgattaatccaagtggaagctgcatcgactgggacagggagacttatccatatctctgccagcttgataatcgtgcggatacagacagctggcatatatcagaggatacagagaaaatggagacgcattttatcagtcttttgagctatctgcgcgatcatccggagattgtgaagattttaaatgggtatcaggaaattccttacgatatgatgatcgagagtgtaaagcaggatggactgcgtatttatggattttcaatcgtctgccagaagaaaaaattattacagctgcgggatgaagaggggatttcctatctgtatgcagtgccgttggattaaataaggttttggggcagggaaagcgttcaaatttattgtttatcggtgcacagtttctttacttcagcgatagacaaaccagagaaattggcgatttcgtctaaggaaaatttgtcagattgcagcattcgactggcaatttcaagagcagcgtgattttcaccctctgcaaatccggcttcatgtccggcttcgcgtcctgcctcaaactctgcttttcgtaattttttttcttctaattctttatcatactcaaaaatactcatactgatgacctcatttcggttctgggtaagaaattccgccagaatcccttcccggatgcattcatccactgcatgttttacggcctcgttcaaaggcatgtctgatgcatagtggcgcactctggcaacatactgtgcatattcttttaacatactgcaatgctgcattaaatctgcattgtgtccttcattgacatttaaaaccgtaacgattaactcaagttttggttcccctgtcagacattcaaatgccgaggaaagccgaagttctgtacagtcagaaattaccgttgaaccattgtagaattcgataaaatttggggcaggaattttctgtaaggtggaagaaaacagtgattttttatccacgagtttctggtattcactgcaaatataaaataaatctcgaagtggcatattagggttgtaggtcgactgatgttcatacagatacagattcgtatccatgataaatgccagatcgttttttattcccatataaatagcattttcgagtgtcacaatctccaaatcttccgggtttttataattactctgattgactgcattgtaaagagagagcagatttttccggtcagaaaacaacatccgaaaaacggtgtctttataattacggtttgccgctggtgttttgaatgtaaagtttctttttgctctgttacggtttcttttgcattttgccataaattttttcctcctgaaattggcaggacagttttttaactgttctctgattgcaggagaatataactatttgtgattctaagttcatctcgtctcctgctttttaattggttaatgggtaacgaaagcatagatacgaatgaagtacgcagactatttggggctaatctgtcgttcttagaatatagatgacaatgtcatgaagattttgtaaaatatgctttgaattattgtaacatagagcgtatataagaagcaagaagtttatgaatgagttttgaaaattttgagagtaatcgttactgtttagtcagtagtaaaacagttgctgttttgttgctgaagaaagtgattcgggagtgagaagtaacaaatatttttagttttttgtaaccaactgtaaaaatcagcgtctttccttatagaaagataacagcagtagaagaacatattcacataaccatcgaaaaaaggaggacaaagcatatgaaacgaaaactggttacaattttgatcggatgtatggcgttaggattatttgggtgtggcagtggattatctgatacgacgaagcggttgacgccgcaacagtcggaggacagtgaacaaaatgccaatcatacaggaaatgaggatcagcaggcagaggctgatacgacagaaaagaaagcggaagatggtagcgcggaaacgtccttcggttaccgataccgccagtttgccctgaatctgctgcagcagacatatgaggatggaaaaaatgagatgatatctccattgtcagtattagcagcgcttaccatgacagaaaatggtgcaaaaggcaatacgctgtcacagatggagcaggttctgtcggatggaacaccggtagggcagcagggcagagaactttcttcgtatatgaaaaaactggccgatacagagaatacgcatctaaacattgcaaattcaatctggctgaaagatgcagacaccttacatgtggaggatgatttcctgtcagaaaacagtaaattatttgatgcggaaatatatcaggcaccttttgatgaacatacattaaaagatatcaatacatgggtttcgcaaaaaacagaaaaaatgatcccacagatattagacaaaatcgaagacaattcggtaatgtatctgatcaatgccattgcttttgatgcaaagtggcagtctccatatgaaaaagaggatgtagagtcaggcacatttacttctgaaaatggaacacagcagacggtggatatgatgtattccacagaagcatattatctggaagatgacagtacgaccggttttatcagaccatatgaagatggatacagttttatggcattgcttccaaaagaagggataagcatagaggattatatcagtcatttgtcagcagaaaaactaatcggtcttgtagaaaatgtcagcacggattatgaagtggatgcagcaatcccaaaattcaagtccgaatattcaatagaattaaaagatacattgcagaacatgggaatgacagatgcatttgatgaggaacaggcagattttcgaggaattggaaccagtgataatagaaatatctatatcaacatggtactgcacaaaacctatatcgaagttgatgagcagggaacaaaagcgggtgcctcaacggttgtcggaatggtggaaacgatgtccttatatgaacctgaaataaaaacggtgcatctggaccgcccatttgtctatgccatcattgacacagaaacacagatgccgatctttctcggagtcacagaatccgtggaagaataagaatgtgccagcattatatgaaaaaggttgttaaataattaacatgtactaaaaaacatacttgagattctatataaattcgtttatactaaattcggtctgacaggaaagaagaaactgacctgagatatttttaatagacaattgcgaaactcataaaaacctaaattgaattgtgaaaaaataacaaaagtttgagaaaacactggggagcggtcggcacttagaaggcaggtgcgatgttaatcgtgactggcttcttagtaccgttaccagcgacacgtagcgagagcgtgttttcgaaaattttgttatttttgaacaattaaaagaagcgtatgaggagtttcgcaattacctagatattcttaagaccagaaggagaatttatattatgaagaaaaaacttgtatcagcactggctcttatgatgtcctgtgtgatgctggcagcatgcggcggaaacaaagtggaagagaatacagccactccgcagaccgagaccagcgaagcagtcacagaatcaacagaggaagcagcaagtacagaaactgaagcagcaggcgaattgacagatgtgaatgtagccgccttaaaaggaccgacagctatgggaatggtgaagctgatggatgattccgacaacggagataccggagcaaatcattacaattttaccattgcagcatcaccggatgagatcacaccgcagattgtgcagggaaatgtggacattgcagcagttccggcaaaccttgcatctgttttgtacaacaaagagggtgtggatgtcagcgttttggcagtcaatacgttaggtgtattatatattgtggaaaatggcgacagtgtacagagtgttgctgatttaaaaggaaaaaccatctatgccagcggaaagggtgcaacaccggaatacgcattaaactatatgctgactgcaaatggcattgacccggaaaaagatgtcacaatcgaatacaaatccgagcattctgaatgtgtggcagcactcgcagcaaatgaggatgcagtggcaatgcttccacagccatttgtgactgtggcaatgacacagaatgaaaatatccgtgtggcacttgaccttaccgaagagtgggagaaggcttccggcgatggagatacaaaggcagccttaattaccggagttgtgatcgcaagaaatgattttattgaagcgcatccggacgcagttgagacatttttgcagcagtatgaggcttctgtaaactatgtaaatgacaatgtggcagatgcggcagtccttgtcggaaactacgatattgttacagcacaggtagcagagaaggcaatcccggaatgtaacattacatttattgccggaaatgatatgaaagcaaaattaagcagctatcttggaattttatttgaacagaatccggcagcagtcggtggagcattaccaaatgatgatttctactacaacgcagactaggaagaaaaataaaataaaactctggaccattgcattctggctgttactctggcagtttgcaagcatggcattagacaagcagatattactggcatcgcccctttcagtggggcggtgcctgctttcgttggtgagaaccttttccttctgggagtcaatctggttttcgctggagcgcatcgcacttggtttcttctgcgcagcggcaggcggcgttttgctttctgcactggcatatcatgtgaaattaatacgcgatatccttgcacttccggtggctgtattaaaggctactccggtcgcatcttttattgtgctggtgctcatctggatgccatcaaaaaacctgtcaatactgatttctttcatcatggcatttccaatcatttatacaaatcttctggagggatttgaacatctggaccgggaactttttgagatggcaaaaatctttcggatgacattctggaacaaaatgtattacctttattttgggggactttttgcgtattttcgttctgcctgcgcaattgcgatcggtatgtgctttaaggcggggatcgcagcagaaatcattggcattccaaaaggctccatcggagaaaacctttacaatgcaaagatttatctggagacacctgacctgttcgcctggacatttgtcattattgcagtgagtgtgctttttgaaaaaatttttcagtggctgttgtcattgctggcgcatcggttaagtgtaaaataatttgcggtttacgcatgtgagcaaagcaaaaaaaggcagtagaaaacaaaaatggaattggtaaaagaaaaaaatggatatcatagtaaaaaatttatgtaaaacatatgatcgtaatcgggtgttagatcatttttcctgtacgttcagggagaaaaaaatgacatgtattatgggaaaatcaggcatcggaaaatccacgctgctatcgattctgatggggctggagaaggcggatgaaggaactgtttccggtatggagcatcaaaagatcagcgctatatttcaggaaaaccgcctgtttgaaaatctggatgcggtgactaacattcatatcacaaccggaaaaacaaaagaagagatcacaggctttttaaaggaaatggaacttgacgatgttgcaggaaagccggtaagtgagtacagcggcggcatgaaacgacgtgtggcaattgcaagagcacttttagcggaatatgatattttgatcatggatgagccgttgcagggacttgacgcagagacgaaggagaaagttgccacagtcataaaaacgcagactgccggaaaaaccgttctttttgtcacgcatgatgagaaagaggcagaatttttcgaggcagagtgcatggaacttgtctgaatttacgcaaaaaagaggcagatcagcacagtaaatgtgtggtctgcctcttttttaacggttcatttcagactgatagcctgaagtattcttatgctgtttgataatgctgtcgatctcctctaagtccgtgaagaccatatcgccgatgacactgtgtttgatggcagccatggcattgccgtattccaaagctttctggcagtctccatgttttaaataaccatacagtgcaccggatacataggcatcgccgcttccgatacggtccacaacgtcaatattattgtatggattttccctgtaataagtatcattttttgcagaatagatgatggaagtaaaattatgcttcttcggagtgatgacagtccgctctgtggaagcgacaacggaaatcgggtattcctcacagaaagatttctggatctcgttgatcgtacctgtttttccaaaggtaagtctggcagtgtcttcggagcagaagaaaatgtctacataaggaagaatggtttcaatgcattttcttgcttcctctccagtccagaggtttgaacgatagttcacgtcgaaggagatcagggttccctgctttttaaattctttgatacagtggatcgcaaaatcctgtgcctttccgccgagcccgagcgtaatgccgcttgtgtggaacagacgggtattataaaaaagtgtctgtggcacatctgagatttctatattattaatggaagagtgttttctgtcatagacaacacggggttttcttggataagaaccatattcatagtagtaaatgccgattcggctgtcgtcggaatggtcttcaatcagataattctcactgactctggaggcattcagctgattcttgataaaggctgccagcagattcgttggtatttttgagatgatggcagtgtttaaaccaagctggccgatctcagatgcgatatttaactctgcaccgccgagatgtttcataaatgtatcgccctgtgcaaggcgtccattgatcggtgtagaaagccttaataaaatttcccctaatgtgatgacatcatatttacgatccatagtcgttttcctcctgtttttggaaaaaatatgtagttcggttctgtcagtttgtaatgatcggttacaattttactggtagatgtaaaattgtaagttttgtattacgaaacaaagttctgtaatatgaaccacttttaaataaattatagcgcatgggacaggaaatgaaaagtacttatttaaaaatatttttgaaaagattgaaaaaacatatttgacatttgtgagaatgatgttataatgaggttacaaattgtgaaacactgtttcactatatggaacatacggatttaaaatatggaggatttaaaaatggcaaagaaagtcgttacatttggtgagattatgcttcgtcttgcaccagaaggatattatcgttttgtacaggctgcatcctatggagctacctatggtggtggagaggctaacgtagctatctctttagcaaactatggtatggatgcaagctttgtaacaaaattaccggctcatgagatcggacaggcaggtgtgaactctttaagacagttcggagttgatacttccaagatcgtccgcggtggtgacagagtaggtatctacttcttagagaagggcgcaagccagagaccatccaaagttatttatgaccgtgcaggatctgcaatcgcaacagcaacaacagcagatttcaactgggatgagatctttgagggagctgactggttccatttcacaggtatcacaccggcgctcggtgacaatgtggcagagatctgcttagaagcttgtaaagcagcaaaagcaaaaggaatcacagtaagctgtgacttaaattaccgtaataaattatggtccaaagagaaagccggacaggttatgggcgagctttgcaaatatgtagatgtctgcatttccaacgaggaagatgcaaatgatgtattcggaatcaaatctgaaggtacagaagtaacagcaggtgagttaaacaaagccggatacaaagaggttgcccagaaattaacagatcgtttcggattcaagaaagtagctatcacattgagaacttctatctctgcaaacgataataaatgggctgcaatgttatatgaaaacggagagagctatttctctaaagaatatttaatgcatatcgttgaccgtgtaggtggtggagattccttcggcggcggattaatttacgcttgcttaaatgattacgctccacaggatacgatcgagtttgcagttgctgcaagctgtctgaaacactctatcgaaggtgacttcaatcaggtcagcgtttctgaagttcagaaattagctggcggagatgcttccggacgtgttcagagataatcaatttattttgctataaatttctttgctgatttctggcagagaaacatttataattcctttccctaatttaatatatggaatcggtggatcacccagtccgccggttcgggaaaagccgtacatcatttttatgtgcggcttttttcctttttagaaaaaagtttcgcaaatgcaaggttttactatcattttgtggaaagcatttcttatgcaaaatatacaaaaaaatgctggaaagctttcttgcagttttcacaaaattataaaaatgaaaaagaaatatactgacagttgcagacttttcgtgttaaaatcgaatagaaaggagaatcagaaaaaaatgtttgaagtaggagaatatattgtttatggatgtaaaggtgtatgtcaggtagaagaaatcacacatattgatattcctggcagtaataaggacaggctgtattatgttttggctccgttagaggacagaaacggcaaaatatatgccccgaccgataatgccaaggtggcaatgagaaaagtcattaccagacaggaggcagagcagctgatcgaggagatgccgcagatcgaagaactgtgggtagtcaatgaaaaacagcgggaactgcaatataaagaggcgttaaagacctgtgatttcagggcatggatcagtattatcaagacattatatttccgaaaaaaagagcggatcgctcagggcaaaaaaataacatctttggatgaacgttatttaaaggctgcagaaaatgagctttatggcgaattgtcactgatattggggcttcctaagagtcagatggaagatttcatttgcagaaagcttgaggcgtagtaatttaggttatgtacaaaatattgcagtctggcatgcttatgaaggcatgaatgtgaaatggacgaatattgtgtaacgaaaacaatattcgcccattttacattcattgcattttagttatgatactgcaatattttgaatttaccatttgtaaaaattcaatcttaaaatccgtcagttcaggtcatgagcggcagaacgtaaatctttatgatcaaataagagttacttttctataaaaaactatttgtaccagtaaaacccatcattttgagtatgaacgaaagcacctttaggtacttgtttgcaaataatgtggacatccatgtaatccggcattggagaaagcataccaataatccccattggaatacatattcccgaaagaaatgcattgggtggagataaaagaaatatagccaaaggtattatacctaaaagcataggcattaaactcattattacaaaacgacgtttgctgattggttcgtgacatactgcaaaagcagcaaacttttttaaacagattcctatgtaaactttttgaccttttttataacaaactccatgtaaaacttcgtgaacaggcagcaatagcagccccaatattattccgaatggaacatatatcggattcattgctttttcgccaatcataaaccatttaatgcatattatcgcataactaaaaataagtggtaaaataccatataacagactgcttttaaaaatattatccggtctttctattcgttttgcattgtttggcaacgtgttttctgggaaatctgtatcccaagatttattaccgcaccaaattattttaggcataaatgcatctcctctaaatcccgattgttttaattcttttcagttccaccttcttgcctttcggacatagcccttgatggacagcagatattttcccgcaggaacatcgtattgtcggctatatagtagtattcactccgtttacagcagcatgctcattttcatccattggaatgatgaggcatttctgaccgttgatggtatcagaatggatctgtccgactttttccggttttacacggagaatgacatcataagttttgactgccgggacatcatcatccgaatcatcgaccgggatggagcgggtttcttccagctgatgcttcaggctttccacctgttctaccagttctaatttttctttgcgtttcgcatttgcctcgactagctttggatcaactaaatgttcggcggatggtaaatcttcaccgaaagtgtcctcgtaggttttctcgattacagctgtctgttcctcagaaagtccactgtcggagaggacagaggcgatatcggtcagggtgagcggtgatggctctttttcttcctcatcctcagcaggaacttcgatcaaaccactgagatttccctgaatgtcaagaaacatagcgtcgctttcctcatcatcttccccgatcacatccttgacgatgttctggaaggtgagtttcttttctgtcgcggtaaacttagcaccgcagccaagaccggcttccataaattccgtatgcggtgtcttggtatcccttgtataaaacataacagagtggatgtctgtgcttcggtcggtaaatgcagggaatacaaaaccggtgtccggtgcgccgacaacccagtcacggatacgtggacctatgcggttttcgtcctcacggtagccaagtcccggtttggtcaggttgaccgggcagatcgcacacagcagatattcgtaaacttcctccgactcgtctaatttgtcattgtctgaagttttggtcatgacatcgtaggcatcgtggaagatcaggatcagataattgccgacgtaatcgtaactgtcaataatcatatcgtaaaacgtgtccatcagatcatcatttttcagtctgctttcgcgcagtcccatcagaaactgctgtctgccgccggcagcttcctctgcaagtggaaattccagctctaaaagattgtttctgatcgtgccggacaatactttttttgcaatctctaaatatttgtaaaattcttcgtcctccagattcagaaaagtttctccgattttggtgattttattacggtcagcgtccacgtagcagccgcacattctcgtaaaggtacaggcttcttttttaaaacgccgcttgatttctaaaatatcttttttattcatagtaattctcactttcctgtcatttttcatcaagtagtataacatatttttcaaagtgcgttaactgtgaaaagcagaaaaaatgcttaatttagaaggtaaactgcaaaattcagtattgctgcgaaaatacaccagaacagataaggaatctgcagatagtttgacaaactaaagaaaaggatgctccacataaagttaaaaaatagctggataaaatatgtgcggagtgccaaaagcttatccggatgctcagactgcgcaacaatataggaagaaactcccataagcagatataaaatcgtccatataatcggaaataaaataccgggcggtgcgaaagaaggttttgtaaatgaggcgtaggagccggacatgtttccagtaaacagtgcagaaagagcgcctgccgcgaggggaatcagaagaaaaataataaaaatacttttattggtggaatggtgtttcattggcgaaaactccaaagagggtattacttcattttatgtggtgggagaggaggttatgaagaaagagataataaaagagagagccggagcatagattgtgcagattagagtattgtggacaaaaaaataagaaatattcatttgaatatttcttatttataagagcgcgagacgggactcgaacccgcggccccgaccttggcaaggtcgtgctccaccaactgagccactcgcgcatgtttttgtgcttctgatttgaaacacatcatcaatataaagttttatgagagcgcgagacgggactcgaacccgcggccccgaccttggcaaggtcgtgctccaccaactgagccactcgcgcatattgttttgtgttctgccgtgtgccagacacatttgatataatactatgagataagaactttgtcaacaacttttttacaaaaaaacagaaaaaacttttgcataacttttatatgaaattttatcaggaaaattgcatgatctttgaaatgcggcatacaatgtaataatcagtggcaggagatacatcaatgagtgcaaagacaaaaatcgtagtccttcatatgaaagaactcatttatacagcaatttttgtgggattaggaattctgctgattatgttgctgctttttatgtttttaccaaaaaaagaaaaagataaatctgtggagacaatgaaatatgtggcaggagtctacacatcttccatactctttcatgacagcactttggatgtgcaggtcattgtggatgagaaccggatcaattcgatctctcttgtgaatctgaatgagacagtgacgacaatgtatccgttggtggagcctgcgttagaagaagtgtcagaccagatcatcaaaacacagtcggtggaaaatatatcctatcaggcagacaatcagtatacaacggttatgcttttaaatgcggtggagaatgcgcttgaaaaagcagaaattgatgggacgatggaagagtaaaacagatttaggtggcgtagtgtcgcagattttgtggtgctttcttaggttgtgaagggcagatataagcgtcctcttatatgttgattaaaaagaaaaatcgtacagacgaaatattatgtttctgttcgctagacattccgatggagttctaagcaacaatcatgttcagcaagagcttccatgattgttagaatcccatctccatagctcacaaagaaaataatatttgtctgtacaatttttcttttcatttacgctgtgaatgacttgtaaaagaactcttatacatgcccaatcagcgctgtgaatcgcaccacaaaatctgcgattcaaggtgcttaataccttgtaatccgtcaatccttgttacgagcggcagttcataagttaaactggaagttgattattttacaatacttttaatataattgtaatcaatctttcctgttacaacagaataaaaaaacggatcttttctaattgtatcctctgaattaataataaaattattccatccatctgcctcgtttccgtcagataaataaatggttattttgaaactatatcccgtatatccaacagacggtttccactttttcactgtgacatcattcaaattttgtataatatgctgaatctgctgttcatcagtaatatgtgttgtttctccactattgccattaaaaacaacaatttccatgacttcatcaggagctaaatccgtcaagttaagagaaacattgtaccacacaataatgccaatcaaacagattaccattgcagatagtaacataatcattttctttttcatgtcatttcaactcctttggtcaactccgctttgctaaattcgttaataccaaaattctaccataaccacatctgtaatttacgttatgaaactcgtagtaacaggtgttcaggtaaactggcattatcagttgatcacttgatatcgaactctgatatatgagtcatttaaaactgtgcaatcaatgagtttcaggacacccagctcagataattcattttctgaaagaatggaactgccatctattaaggaagcggtttctttaccgccgatcagcaccggagccacaacgacatcgatataatcaaacaacttcgcacgaaggaataatccgtttaccgttccaccgctttggattgttaatttgttgcatccatacgatgattttaattcatgaagagcatctttcagcgacagtttttcctgaaaaatgatatggagattattttcctgaatgttataagcaggatgatctttattggatgtaatcagcacaaacacctgtgatttcttgcagaaatatgttacgccatgttcggtcaaatggttgttatccaataagacaaatgagacgggagtcttatcgggatagggcttttggtttacgcccatcttttcctgcacgcgtcctgtattaaaagaccaaaggtcggttgtctgctcgatttcataatactgaggcagtccctcttttaacccgtctatttttggaaaatccttatctacatctaaagcatctgatgcaccgggacttatctttccatctaaagacataagcataaataacgttgttattggtctgtccataataaacctccctaaaaattaatttgtcaatagtaaaataataccataaccacatctgcaattccacttcattctaattcactttgtgctataatgtgttatcagatttttttgccctgattttccaatttcactctacggagcgtagaaaccgcataaattcaccatattctacgccgcgtgggtgtgattgatgatcaaatcataggataatcagaccagaaaggaggaaaacggatggatcaaatcaagattggtaaatttattgctgatgaaagaaaacgaaaaggatatacgcaaaaacagctttcagaaaaattagcaatcagtgataaaacaatttcaaaatgggagagaggaaatggttttccagaagtatcattgctgttgccattatgtaatgaactggagataacagttaatgaactactatctggtgaaagagtatctgaagaagagtatctgaagaaagcggaggaaaatatggtgaatttagtcagagaaactcaggaaagtaaaaagaaaattgtcctgtcagcaatgattgcaggacttacaattatagcggcagttccattatttatattgtctggaatgctggagatggagaactggattagagttcttcttataggaatagggcttgttgtgatagttggaggggttgcaattgcctgtgtccttgacagagaagcaggagcctttgaatgtcccgaatgtcataatagatttgttccagatatgaagtcatatattatgggaccgcatacaattacaaagcgaaaattagtatgtccgcattgtggtgcacataaatattgcaagaaggttcttacaaagtaaacctgaaattaaatctatccgctctattatagaacatacgttctgcaaaaaaatcattataaacccagagttccataacgtaaattgcaaattctgtggtgcgattcacagcgtaaattgggcaaatataagcgtcctttcacaagtcattcgtaacgtaaatgaaagaaaaatggtgcagacaaatatgatttccttcgtgagccatggagctgggattctaaaaatttcgtgaagctctgcttcacaaaatttttgctcagaagcccagcggaatgcccggcgaacaggaacatcatatttcgtctgtaccgtttttcttttcataaacctataaaatcacgacttgtgagaggacgcttatatctgcccttcacaccctaagaaagcaccacagaatctgcgacactacgtcaattaaactccggttaagccgcagctttcctgccgaagagctttttcagacaactgaatgcaaccataacaccaagtaccataagaagtacggcaacaacaaattgaagtccgtctacaagaagtgttgcattaccgctcatgaagttgctgacaagggcaattgttttctgaatcagagcagtgaacgtaactgccagcataacaaacattggaatgtaaagtgtccatccggtacgaccggttgtttttaagaaaaccgctaaggcgatcaatacaagtgctgcaagcagctggtttgcagagccaaacagcggccaaacgttgctgtatccgccgagtgtcagcaaatatccgaaaaacagtgtgatcacagttgcaaaatatttatttgtcagtacacgctgaatcggtgtcatagttgcaggatcggtggaatctccgtagaacaattcctgaaaagacatacgtccgatccttgcaacggagtcaagggatgtcagtgcaagtgcagatacacacatggtcataaatacagttgcaacggtaacagggacaccaagtttttcaaggaatcctgcgacaccggaggagaagatggagaatggagttccatcaggttttgttccgtttacggcgactgcgccgacaacaactaaggagacgataccgagtaaggattccacgaccatggcaccatagccgaccataggcatgtctttttcgctgctgatcgtcttggaggatgttccggaagataccagactgtggaaaccggaaacagcaccgcaggcgatcgttacgaataaagtagggaataaactgcttccacctacattgaatccgctgaatgcatttaactgcatggaaggatgtgcaacaatgacaccgacaaccgcaccgatgatcataccgagtaacatgaaggttgtcatgtaatctctaggctgcattaaaagccacattggcataacagatgctaagaacagataagccattacgatgtagatccatgcagttttggtcgtgcagatcgggaacttcataccgatgatgaacataacgactaaaagggcaattgcaacgattgcttttatcacttcgttcatcctgcttccaaggtgtttctggatcacaccgaagataacagcgacaacgataaataacatggaaatcgaagcggcggcagaattggcgtaagaggttgcatctgtcatgccttcaactccggttccgacaaatgttccggcaaccatatctgtaaatgctgcgattactaataaagtaaataaccagcagaataacatgaaaagtttccggcctgttttaccgatgtacttctcaatgatcatacccatggatttaccttcattttttacggatgcatataaagcaccgaagtcctgtacagcaccgaagaaaagtccgccgatgatgagccagagtaataccggaacccatccaaaaacagatgcaaggatcggacctgtgacaggacctgcacctgcgatggaagaaaactgatgtgagaatacggtaaatttggaggagggaacataatcttcgccatcctcatgtgtgtaagcaggggtttttgcatttgggtcgattccccatttctttgcaagccagcgtccgtagaagaggtagccagcgccaagtgcaacgataccgatcaaaacaataactaaaccattcataacttttttccgccttaaggcggctcctttctgaaaatgtatttttttctgggaacaaaatacattgtgcaaagtggaaacaatgggattcacatcctgcgcacagtctgctggcatgaaaaaaagccttcatctccggatatattcatatctcaaagacgaaggcttaagcttccgcgttaccactttgtttgccgtaaaatacgacctctctgtcttatctttgtgggcagatgcctacaacaataagcttctaaataacggtagaataccggtgacacttactatgaaaattcagtgcactgctcgcagaggatagttcctgaagctgtatactgccttacaccaaccggcagctctctgtgatacaggttgctcagataaccttgttctgttcgttgcattttgttctctgtttgaataacaaaatagcactttgatctggtaaagtcaatggtcgatttttaatctgttttattgatttattttaatcgttactgttcactcgtacctcgttccagtaatttttattccgcatttaaagaactcatatagtctgtaacggaatcaaggtttgcataaatggtttccataggtttgcctgcttcataagcactgtatccggagtaaccggcccagccgatgataccgacagcgacaaggcagccagcgacataaccggcgatacgcattctcttttcctttgccataattttcttacgattctttttttcttctttataacggtctacttttgcctgactcataatcaatctcctaacttcttaaactttcttcactatactgcattttactggaaaaatcaatgaaatttggtagaaacagaaatgaactttatgacaaaaatatatcgcagtcataaaatattcgaataacagtcgggatgttatttcttgcactttatacgaaaattggatagaatagtactgttcggatcgtacatgggcattttactgcaaaggtacgaaagaatgagattttcaaatgtgcaaaatgatagaaagatggggatagaaaaagatgagtcttgcggacaaaatttttgtaaatatgtgtaaagatattttagagaacgggacaagcacggagggcgagaaagtccgcccacactgggaagatggaacgagtgcctacacgatcaaaaaattcggtgtggtcaaccgttatgatctctcaaaagagtttccggcaattacattaagaaaaactgccatcaaaacatgtacggaagagatgctttggatctggcagagaaaatcaaataacatccatgatttgaacagtaccgtatgggatgaatgggcagacgaagatggttccatcggaaaagcatacggataccagttaggggtaaaacatcagtataaagaaggcatgatggatcaggttgaccgcgtgatttatgatctgaaacataatccgttcagccgccgcattatgacaaatatttatgtgcaccaggatcttcatgaaatgaatttatatccgtgtgcctacagtatgacatttaacgtgacacacaaggagggagatgaaaagctgactttgaatgctatcctgaatcagcgttcccaggatgtgttagcggcaaataactggaatgtgtgtcagtatgcggtattaatgcatatgcttgcgcaggtgtgtgatatgcaggtcggcgagctggtacatgtgattgcggatgctcacatttatgaccgtcatatcccgatcattaaggaactgatcgggagagagcagcatccggcgccaaaattcacattaaacccggaaatcaaagatttttatcagtttacgacaaaagatattaccattgaggattatgtgacgggaccgcagatcaaaaatattccgatcgcagtataagcctgactggaatattttatgagaggataaaataacacagcactgacaagtgatacagagtgaaaagttggaggaaatatgaatttaatcgcagctgtagataaaaactgggcaatcggatgtaagaataaactgctggtgagtattccggcagacatgaagtttttccgtgagacgacaaccgggaaagtggtcgtcatgggaagaaaaacgttggagagttttccaaacggacagcctctcaaaaaaagagtgaacatcgtgctgacgcatgataaaaattttaaggcgggagatgccattatcgttcattcgatggaagaattgcgggaagagttaaagaaatatccaagtgaggatatttatgtaatcggtggagagaccatttataaacagcttctcgatgactgtgatgtggcgcatatcacaaagatcgactatgcgtttgaggcagatgcctatttcccgaatcttgatgagatgccggagtggaaaatcacgcaggacagtgaggaacagacgtattttgatctggaatattatttttataaatacgagaggattaaataatatcaataaagttgttaaaatatatcataccaaaaagatgaaaattgatttataattgctaaaacccagacagagagactgctgggttttacctttacttgaatgaggagtttccagataggaaaaagaaaaaaatggaaaattttatatacagtatcaacgtgacaatgcctatttttcttgtgatggtcattggttatattttaaaacagatcggaatgttaaatgataactttgtcacagtggcaaataagttcaatttcaaggtcacgcttccgtttatgctgtttaaggacattgcaggcgttgatattaaagcagtatttgatattaaatatgtgcttttctgtgcgatcgtgagtaccatctgtttctgggtggtatggggtacagcaaagtttctggtgcgggacaaaacgatccgcggggcatttgtacagtcgtctttccgtggaagtgcggcggttatggggctggcttttatccagaatatctacggttcctctgcaatgggaccgctgatgatcgtcagtgcagtgccgctctataatattttttctgtgatcgtgctgacatttgaggcaaatgacagcacaggaatcgacaagaaggcaaagatccgacaggcgggaatcaatatatgtaagaatccgatcattttaagtatcctggcaggactgatcgtgggactgcttgagatccagttcccgacgctggtaaataagacggtcagcaacgtggcgcagatggcaacccctttggcactgatcaccatcggagcaggatttgagggaagaaaagcgctggcgaagatcgcaccgaccatggcggcgtccatgatcaaactggtgcttcagccacttgtttttctgccggttgctgcctggatgggattttcaggggaaaagatgatcgcaattctgatcatgctggcatccccgaccacgccgagctgttatattatggcaaagagcatgaacaatgatgaagtgctgacggcgagcgttattgtaacaacgacattgatggcggcgtttacgttgaccggatggatttttttactcaaaacattagggtatatcggttagtcagaggaaaaaagatacatattcagcagaaagtatcattttatgaaagcacagattattttgaagtataaatggaaagggtaagacagaaagatggatattacaggtagaaaattatttgtcaaggcattacaggaagagggtgtcgatacaattttcggttatccgggtggaacggtgacggatctttttgatgaattatataaacaggatgagattgaaattgtcttaccaagacatgagcagggacttttacatgaggcagagggatatgcaaaatcgacaggaaaagtgggtgtctgcctggtgaccagcggtcccggtgcaacgaacatcatgacaggacttgcagatgcacattatgacaatattccgcttgtctgttttaccggacaggtgccgttaagcctgatcggaaacgatgcttttcaggaagttgacattgtcggaatgacaagaagtatcacaaagtatggtgtgacggtcagagaccgcaaggatttaggaaagatcattaagatggcctttcacattgcaagcacaggaaaacctggaccggtcttaattgatcttccaaaggatatccagacggcgagcggaccggcagaatatccggacagcgtgcagatccgtggatacaaaccgaatgagagcgtgcatatcgggcagttgaaaaaagcatacaaactgttaaagtcagcaaagaaaccattgatcctggctggcggcggtgtcaatattgcaaaagcaaatgagctgttgaaagaatttgcagagaaaatgaacgttccagtcgtgacgaccattatgggaaagggtgcgattgccacaacgcatccgctttatatcggaaatacggggatgcatggaaaatatgcaagcaataaagcagtcagtgagtgtgatgttttattttccatcggaacaagatttaacgaccgtattaccggagatctgaatgaatttgcaccaaaagcaaaaattgtacatattgacgtggacactgcttccatttccagaaatgttgtggtagacgttccaatcgtatcggatgcaaaacttgccctggaaaaattgctggaatgggcagaaccaaaggatacggctgcatggcaggagagaattaaggcgtggaatgagaagaatccacttgagatgcgcagagaccgcggcatgacaccacagatgatcatggaacatatcaaccatacgtttgacgaggcaatttttgtcacggatgtaggacagaaccagatgtgggcaacgcagtatctggatattgacgaaaaacgccagatgatcacttccggcgggcttggaacaatgggattcggttttcctgcggcgatcggtgcaaagattggaaacagggatacggaggtagtctgtgtcaccggtgatggcggttttcaaatgaacattcaggagatggcaacagcgatcgtgcaggggacaccggttatcatctgcctgctcaataaccagtatcttggcatggtccgccagatgcagcagcttttttatggcaaacgctattccgcagtatgcttaagaaagagaagaagctgtccggcaaactgcaagggaccaaatgaagcatgccctccatatacaccggattttgttgcacttgcagaaagctatggtgcgcatggcatccgtgtagagcgggaagaagacattcaggcagctttggataaagcgagaacttacaaagatgcaccgacagtcattgaatttctgatctcatcggatgaaatcgtgcttccgatggtaaagggcggaaatccgatgagcgagatgattttgaaataggcggatacagatatggtgagagaggaaaatatcatgaaagacagatggattgcactatatgtagaaaatcaggttggtgttctggcaaaggtttccggtcttttttccgggaaatcatacaatttgcagagtctgacagttggcacgacagaggacgagacggtttcccgtatgaccatctgcgttaccagtgatgacataacatttgaacagatcaaaaagcagctgaaccgtatggtcgaagtgatcaaagtcattgatctgacagatgtaccgattcatatgaaagagattctgttcgcaaaggttctccgtgtgaatgctgcggaaaaagaagaagtattccagatcgcacaggtgtttaacgtgcaggtggcagatatcggaaatgacagtgtcctgctggaatgcaaactgactgcccatagaaataacgagctgatcgcactgttgaaatcgaaatttaagatgattgaggtagtgcgcggcggagcagtagcaattgaatccatcagtacaagctgtagataataggaatcatgttactggaacgagatacgagtgaacagtaatgtaatcataaaatttttcgaaaattatagcaaaagtaatgtacaacttaaataccctgtgatataataaaaatgttttgaaatgtagtattaaaaactacgttggaaaacgtatatttaagaataagaagtcataaagctattttgaagatgacagtagtaaataaacgaggtatttatgatgcagaaaaaagtacagatcatcagtgatggttccctggatctctcacaggaactcacaaaggaaaaagatattgaggttgttccattttatgtgtcctttgacagtgaaacgtatcaaaaggaaatggtagaagtcggtgtcagggaattttatcaggaaatggtggatcacccgaccgtttttcctaagacatccatgccatccgtgcatgactattatgaggtgtttgaaaaacatgcgaaggagaagatgccggtcatctgtatctgtatcacaaaaaaattcagtggctccctgcagtctgcgacaactgcaaaagatatgatattagaggaatacccggatgcacagatcacggtcattgactctacggtcaatactgtgctgcaggggttatatgtattagaggcatgcagactgcgcgatatgggtttagagtatcagcagattgtagatgcgttactgccaatccgtgagacaggaagaatttttttcacgatcggaagtattgactatttaaaacatggcggaaggattggcagattagccgggattgcagccagcgcattaaaaatcaaacctctgatcacgttaaaagaaggtgagatctttaattccggcattacaaggaatcgtctcaaatccatgaaaaaagtcgtggatatgacaagggaatatttagacgaagtcaatgcgaaaccgggagagtacagtttctgcatcggttatggatatgatcataatgaagctctggaatttcgagagatgttaaaggatctgatcaaagaacgtcttggaattgatgagatcggtatttaccagatcggtgcaaccattggagtgcacacaggaccatatccgatcgggatcggaattataaagcatgcattgatagagtaactgatatgtaccccttttactggacatccagtgaaaggggtacatatcatatcagggcgatttttagttcctgtttccggaactaatgataatattttaagaataatcccgtaagatctccttttaagtttacaccgaggaaagtaagcgtttcggaaagagcgtacatggttgcggccatatcttcaaagtttgcgttatttcccatgtgtccaatgcggatcactttgccggaaagatcatcaaaagatccggcaagcatgatattgtgctcttttttcatgcgggaaagaattgcatcgcaggtggtctctgccggaatgtcaaacacagtgacggtatcggagaaaccgctttccaagtgaagctttaaaccggcttctgtcaaagcgcatctggctgcttcggcgatacggtgtgtgcgttcttctaactctggatcggaagcgatattgtcaaaagcagcacgtaagccgtaaatatcgctgatcggcatggtataaggaaaccattttttctcataatatccctcaaaagccagaaggcttgcatagaaggaacggatcggcgtcttgcgtacgtgcatggcattttttacagcatcgcttattgtgacaaaagtaagtcccggaggtgcggaaacagctttctgggaaccgccgcacagaagatcgatctggaacttgtcgacatccatgtgatttccaaacattccggaaacggaatctacaacggtcagaatgccgtattcttttaaaagcggacagattttttctaccggattgagcatgccgcttggggtgtcacagtgaacaacggtcgcatatttataatcatgatgctcctttaaataagaagaaagagcatccgggtcgatggcattcaggcggtcggcatgataaaattccggcacaccaccgtacatggatacaaagtccgcaaagccttcgccgtacacgccgttctcaatgatgagcaccttatctcccggctcagtgagggaggcgcaggcagcttccagacctaaaattccctctccatccaaaatgaaagtttcgtttttcgtgccgagcagggagctgatcagttcgcaggtatctttataaaattctacgaaatcttcatccagatcaggattggtacatacgaggcttcttgccatacgcacattttcttttacctgggttggcccaggagtcatgactttatacataattacttccttctttatcatagattgttttgtaaatgagattgatgttacacagcttataacattttatttacgattttctgaagctgtccgacgatcaaaagaacgatgacagcagcaacaccaatctggacaaggtttccaggaatggaagtaaccggtgcgatccagtttccgtaaatgataccctctgcaacgtagtaaccagcgactttgatcacgcatgcaactgcgatcgcaagtgtgttccagccaaaaccgtgatgtttttctgtgatggcacctacggcatatcccatcagaccgacaatgatcagtgtaaatggagcccatgcagtccagccggagagcagatcgaagagtcccatgccgaccccgccggcgatcgcaccacttttcttaccaaaaataatggcgcagataaaaagaggtacgtttccgagatggatcaatccgccgtttgcagtgattggaagtcttatattaataaatgcagtgaatacgtaggtcagggcaataaaaagagccgtgatcgtgataaaacggatatttgataaagattttgaatcagcagtctgtgctgtagaggtagttgatgttttcataaataaaattctcctttttatggtttgtatttgtgtcaattcccaggattgttgttgggattactatatacaaaaactgtcatgaattaaaaatccagtttaaaacaaattgaccatgccagttttaaatatataataatattgacaaaacaatactatatgatgtatagtattaaacaagaaataatattacaaataaaataacaaggagtgagtacatggtatttaatacaggcgcagcccttttggatgcgattgttcttgctgtcgtgtcaaaggaggaagaaggaacctacggatataagatcacgcaggatgtgcggaaagcgattgaggtttcagaatccacactgtatccggttttgcgaagattgcaaaaggatggatacctgatcgtgtatgacagggagtgcggaggaagaaaccggagatattaccagattacggagaccggcgaagaaaagctggcagaataccgcagcgagtgggaatcgtattcttcgaaaatatcagaactattttcaggagaggagtcagaagaatgaataaagaagaatttttaaaacgtctggagcagctgctttcggatgtttcagaggaagagagagcggatgcacttgccttttacagaagttattttgaggatgccggaattggaaatgaggcatcaattttagaggaactggagtcgccggagaaggtggcggaagtgatcaagaaagatcttggggtgagtgaaacggctgatgcggaaacacctgaggaagatgtgcgcagcgaaaaaaatgagactcatacagaaggaacatctggggatggtcaaaatgccaaaacacgaatggatgattcatatatgaacagtttatatggaagcagtacttacgggtcaggtaattataagcagaagaatactgcttataccggcggaacttatggcagtcagaatacgtacggacagatcgatatagagaatctgaaaaaggaaaatcagaagaataaaacagaaaaaacagttttatgggtgattctcgcagttttgacaagcccgatctggatcacggttgcagcggttctggcggcgattcttgtagcagttttagcgtgtgtgtttgcagtggcagtcagcattgttgcagtgatggcggcgttagtgatcactggatttgtattggcaggcattggtgtcggatatcttttcacaaaaggcgtggcagtaggtcttggactgttaggcggtggacttttggttcttgcgcttggagtacttgcagtgtggcttgtggtatggtgctttggctggtttgtcccatgggcagtgaaaggcattgcagagctttgcaaaaaggcatttggcaagacaaagagaggagtgtgagatgaaatgaaaaaatttacaaagattatattgatcattgcaggaagcttagccgcactcggaattgttttcagcggtatcgccgcagtgatgggagccggatggtcaaccatccaccggaaagcacttgccggtgaacttgattttggcaactggcatattggcaatggagtttattatgcttatgatcagggacatggcatcttggatcatttttgggatgatgattatgatgattgggatgatgattatgatgacgatgatgattgggacgacgactgggataatgacgactgggatgatgaggatgacgagctcatggatgataatagggcggtggagagttttggttcctggatcctgaatcttacggatttgaagagtgaaccggcaggaacggaaagctgcattataccttatccggcatcagaagatgcttccctgaaactggaactggatgtggtagatgaacttatttttgaagtgtcggattctgcggatgagatcagtattaaaatggaaaatgggtatcaggattatctttctacaaaacagaaggattccaatctgaaggtatcctatcacagcggacaccaccattttgagaaaggaccgacctttacggtagttctgccaagacagtgcgaaaatctgacactggacattgtagtgggagccggggatatttccatggaaagcgaagcgtttacggcaagaaaagtaaatgtgtctgttggagtgggagaactctctgtgaatcagatctcagccagcgagaaagccgtgtttgaagttggcacaggagatgtgtcgattctgaatggacagttcccgaaagtgtctatcgaagcaggagttggagatgccgtgttcagcggaagcgtttcaaacaaactggaagtggaggcaggaaccggcgatgtcaatgtctctcttaccggaacagagaaaagctatgcatttgatctgtctgccggacttggaaaaatcaggttgaacgggcaatcgaaaggggcttttgatgcggagtatgagaccggcagcaacggcggagcagaagtggaactgactgcaggagtgggagatatttctgttttgacacagcagtaaaagagataaaaaatagatggtttacattttttgtctttatgatataatataaacataaaaaggtgctaccgatagatggttagcctagattatatgtgttatgtaaaaataaccgcaaccttggccggggcggttatttttttctgccgtgattatctttcccgatgaggtaaaataatccggcaacactaattaacaaactcattaactgtaaaagttcacttgttgttatcattagtatcccctccatttcaggtaaaaaattcctaatctttgtctttttaatcacaatatgatatgatgaacacgaaagaaaaaacatacaagaattcgtatattttaataagaagaacaggagcagggaatgggaaaaagaacaagaattattttatatgcactgtcacttgtgacaatgcttgcgatggtgacactgatcattttttcacatggaagacagagcggtgagccggcgaaagatgcgctgtccgagacggatatcagcagcacggaggaaccggttcagataccggaagcggaagagccagaagagacggaagcagcagacgggcagaacgggatccaaaacgatacagaacaggaagaagtggacatagcagatgacacaacactgatttttgcaggggatgtactgtttgcaaacgcctttaaaagcaactatgatgcgggcggaattgaaaaagtgatcgagccgcagctgctgcaggagctgcaggatgcagatattttcatggtgaataatgagttcccattcagtaaccgtggagagccgatggaggacaaacagtttacgttttgctgtgatccgaaatatgtgaaagctttaaatgagatgggcgtggatattgtatcactcgccaacaatcacaccttagattatggaagagatgcgttgtctgatacgtttacgacactggacggagccggtattttgtatgcaggagccggagagactaaagaacgcgcatatgaattgcagattatcgagaaaaatggaaaaaaatttggatttcttgcggcatcccgcgtggtgccggaatcaaactggaaagtggaagaacggacaccgggaatgctgaccgcttatgatgatacaaaattggtacagttgatcaaagaagcccggagcggatgtgattttctgtcggtctatatccactggggcgtggaatacgatgcgtatccgcaggactatcagacaaagattgccacagattgttttaatgcaggggcagatctgatccttggagcacatacacactgtttacagggaatttcctatatcagtgggaaaccggtcttttacagccttggaaactttgtgtttggacagaacattgataagacggctgcagtgaaagtacaggtttcgtccgatggaaccgtatcttatggattacttccggtttatgcggcggggggcacaacaaaactgatggatacaaacagtgcatctgcgctgtatcagtatatgacacagatttcagatggcgttacgatcggtgcggatggaaaaatcaattaaaggggagaagaacatgaaaaagaaacttatgagaatgccgaaggtggttacgatactcgttgcggtactgattgtagcgatttttcttggaagtatggatgtggcagcgttttttcttgcagatacagtttcgcttccgggttatggaagcagtatgatcgcagagtttatggcaggagtggttgcatttctgcttttgtgcctgtttggttatcttggagtgctgggagaaaaaggaaagggatttatccatggcctttatatcggcggattcctgacaggatactgttgtctggaactggcggcacagctttatgtacagatgatgacaccggatgcaaaagtcgtatctgcattggaaatcctgttttttgctgcaaccatgtttctgatcggatggacggaggaacttattttccgcggtgtgatcctgaatctgtttctggaacgtttttccaaaacgaaaagagggattctctgggcggtcattctcagtggtgtattgttcggggcggtacatttgacaaatatttcacagggagtgacggtgacaagtgcgatgattcaggcgatcaacgctgcctttctgggtgtgatctttggcgctgtttatgcccggtcaggaaatatctggcttgtaatgacttttcatgcactggtcgatttcgcaagtctgatgggcagcggaatttttggaactggaacaactgtggaacagatcaaccagatgtctgccgctaatttgattgccgttcctgttttgctgattccgtgtattgtgctgcttcgcccgaaaaaacttctggagatggagcaggaggcaaatcatatcgtggtgtttgaaacattcgaggaggcagaccggaatgctgctctgtcgctcgcacttggaatgatatccattctgacaggctttatgggatatggtcttggtattgggatcgctgggctgatcggtggcagactttcaagaaaggtgcagccggagaaaaacggaatggcactggcgggtatgattttatccggaatcggtatggcggtatcgatcattggaatgatcgtgctgtgttttgtctattcaaatctgaatggtctctctgccgttatgatgatgaatggtgtgaagtgattttaagacaaataagctaaaacaagtttacatttactaaaaatgggcgtgtgaaaaaacgagagttttttcattcgtccttttgcttatagttataataatagctatattacataaaaaagggtatagttccccttaccccataagaatgatattatgaaatcttatgcggcagctgcaacttttttctgtttgttgtgatatttataaagattgtgtccgatagaaacgagaaatacttcaagcaatacagattttattcctcttcggacaattcttttgtaccaccggtcgtttttcatgataccaaaggtaccttctgcctgaatggatctgttcatccttagaagcgctccctggatgctttcgagattttctatcacttcctgatgcatcgctgtaagttcgcggttgatccgtacagtacggtttttatctgtctttttacattgttctgcatatggacagccggagcaatcttcacactgatacacttcttcctgacgcccatacttgttcccttttacgttttttcgatactgaagataaaagcttttcccatttggacaacgcatgattccgccttccccgattggaaaatttactgcacgaaatggatcttcatgatacttcttgtctgtagtctctttcttgaacatggtaaatttcatatatttttccattccatgctgctcacagaagatgtaattgttgtaagaaccatatccagcatctgctactgggtacttcggataaaagccatatgtagtataaaacttgttcattaatggaataaaacaatccatatctgagcgatactgatttacatcaacaacagcaatatattcatctgcaataccgacctgtacattataagctggaagcaactggtcattgcccatgtagtctgtcttgattcgcataaaagtggctgaatggtctgttttcgagtaactgttgcgatcttctccacagattttgattttttccacgtattcttccaacttagcagcatactctttgagtttctcataatgacgttgttgtgtagttttgcgatgtcccctgccatgaacaaacattgcttcattaatctgccagacttctgcatactgttcagcagcttccttcagatactctggtgcgtactcactattgatacaaagtttcatacctgtacatgaaagttcctcattgatttcctcaaagagtgtagttaccttaccaaagagacggtatctggatttttcggttgcttttttccatacccaggagtatttattcgcatttgcttcaaacttggatccatcaatgtatagatgttgaagatctacatgctctgtctcgaagatttttttgtttatatcttgaaatatttcttcaatggaatcagcaagtacttcgttgatgaagtagccgaaagtacggtaagaaggtgcttgatgatccataagatacatgaagcggagattgactttacactgatcctccagttcacgcaatgatatatagccattcgccataaatccaaacaaaactgttttcagcatgctgaccgggtcatatctgagtcttcctgtataatgttgaggaatatttttcagatatttctccagttcgatttctcccataaatctatcaaaagtcagcactggatcacagatgtccaaataatcttgaattagcattggcaaaactgcctgttttgggttagaatagattatgttattaatttttttcacaaattaattataacagaaagaaagaccttgagttcattataaactcttggtctttctttttttcgggactattcttttttcacagccccttgagagagcggtaaaatctttcaaaaatagcaggaagaagataggagaattgcgatgagttacatggaaacctacagagaatggtgtacaaacccatatttttcagaggaaacaagagcagaattagaagcgatcaaggacaatgaggcagagatcgaggatcgtttctaccgtcagcttgagtttggaaccgggggactccgcggtgtgatcggggcaggaacgaaccgtatgaatatctatacggtaagacaggcgacacagggacttgcaaactatatcatttctcagaacggacaggaaaaaggagttgccatcgcacacgattccagaatcatgtcaccggaatttgccgaggaggcagcgctctgcctgaatgcaaacggaatcagggcttatgtgtttgacagccttcgcccgacaccggagctttcatttgcagtccgtgaacttggctgtgtttcaggaattgtgatcacagcaagccataacccaagagaatacaatggatacaaagtttactgggaggatggtgcgcagatcacaccgcctcatgataaaaatatccttgcagaagttgcaaaagtaacttcttttacacaggttaagactatggaaaaagaggatgccgtgaaagccggactttttgtgacgatcggaaaagaaatcgacgaccgttacatggaagaactgaaaaaacagtccatccatccggaaatcatcaaagagatggcaaaggatatcaagattgtatacacaccgctacatggaaccggaaatctcccggtgcgccgtgtgttaaaagaacttggatttgaaaatgtctatgttgtaaaagagcaggaacttccggacggaaatttcccgaccgtagcatatccaaacccggaatctccaaaggcatttgaacttgccttaaaacttgcaaaagaagtggatgcagacatcgtgcttgcgacagatccggacgcagaccgtcttggcgtatactgcaaagacacaaagaccggagagtatgtgactttcaccggaaatatgtccggaatgctcatagcagaatatattttaagagagaaaacggcaaccggaacgatgccggagaatcctgcacttgtagagactatcgttacaacggacatggcaaaagcgatggcagcttcctatggcgtggcactgatcgaggtactgaccggatttaagtatatcggagagcagatcaaatggtttgaacagaaccactcccacaactatgtattcggtctggaggagagttatggatgcttagccggaacatatgcaagagataaagatgcctgcgtagcagtcatgatgttgtgcgaggtggcttcctggtgcaaaaaacatggaaaaacattgtgggatgccatgatcgacctgtatgagaaatacggttactacagagagggactttccacgatgaccttaaaaggaatcgacggagccgcccagatccagcagatgatgagtgatatgcggaacaatccaaagaaaacactcggtggatttgaagtgcttgcagtccgcgattacaaagaggatacaagaaaagatttaaagaccggggaagtgacaaaaacaggacttccggcttccaatgttttatattatgaactttctgacaatgcatggtgctgtgtgcgcccgtccggaacagagcctaagatcaaattctactatggagtcaaaggcacctctttgcaggatgcagaggaaaaactggaagcattaaaaaaggatcttgtggaagaatagataaatgaatatttgcagaagttgtgattgcctctgagaaaaaagtaaatatataatttagatttaatatttataccaaaataaaaaacaagaatcagagacagagaaggagaatcacatgtttgatgacaaatttgtctggggcgtggcaagcagcgcatatcaggtagagggaactgacccggatgacggaagaggaaagacggtctgggacacttttacggagcagggacgcatttttcaaaatcagaatgcgtacacaagctgtgatcatatgcatcattataaagatgactatgcattaatgaaaaatctggggataaaagcataccgtttttccttaaactgggcgcggattctgccggaaggtaccgggcgcgtcaatgaaaaagcaattttgatgtaccgtgacatgatccttacaatgaaagaaaatggcattacaccatatattaccctgtttcactgggagtttccacaggcattgcaggaaaaaggcggctggctgaatgaggaagtggcagactggttcggggaatatgcaaaagtggtggcagagaatttttcggatctctgtgagtattttatcacgatcaacgagccgcaatgtgtggttggacttggacatttaagcggtgttcatgcaccgggattgaaattatcggttccagagacttttcagattgcacataatctgttgaaagcgcacggacaggcagtgatcaatttaagaaaatacgcaaaacaaaaaatacggatcggctttgcaccgaccgggggagtggcttatccatacacggacagtgcagaagatatcgaggctgccagaaaagtttattttggattttacaatccgatggataactggacctggaatatctcatggttttcagatccggtctttttaggtcattatccgaaagagggactggaaaaattcaaagagtatctgccggagatcacagaggaagatatgcagctgattcatcagccactggattttatgggacagaacatatataatggctattatgtgcgtcagggcgcagacggcgaaccggagtttgtggaccgggaaccgggatttccaaagacggcgtgcaactggccggtaacaccaaaagcattttattatggaatcaaatttttgacggagcggtatccgcttcctttgtatatcacagaaaatggtatgtcctgtcatgataatgtgagctttgacggcagagtacatgacaatgatcgcatcacgtttttggattcctacatcggagccatgcagagggcatatgatgagggagccgatatccgggggtatttcctgtggacatttctggataattttgaatggtccgagggatacagggaacgttttggcatgatttatgtggattttatgacacagcggagaattgtaaaagattctgcgttttggtatcagaatgtgattgggacaaatggaggcaatttatcaacaaatcagaccacgaaagaaattttatttttagatccggtatgtacacacaacatctggggcggtacgcgattgagagaggattttcattatccggtcgaaggtgatgatttatgggagtgctggggaatttctgcacatccaaatggagacgtaactttaagagactgtggattccgtggaatgaagctgtccgaattgtggaaaaaacatccggaagttttcggaaaggtggacagtgaccgtttcccgctcctgatcaaaattatcgatgcgaaagatgacctgagcattcaggtacatccagacgatgattatgcaaaagtccatgaaaatggttcacttggaaaaacagagtgctggtacattctcgactgcaagaaaaatgcgacgatcgttatcggacacaattcaaggacaaaagaggaattaagccggatgatccatgagggaaagtggagtgaatttatccgtgagatcccgatcaaaaaaggcgattttcttcagatcgatccgggaacagttcatgcgatcaaaggcggaacactcattctggaaacacagcagaacagtgatattacctaccgcgtttatgattatggccgtctctccaatggaaagccgagagagctacatatcgacaagagtattgacgtgatcactgtgcctgcaaaatcggctgcagacagtgtgaaatcggtggcagatcttccggtcaatacgttaaatgaactgtatgcctgcaaatactttcatatctataaaatagatgtttcaggtaaaatgacttttgagcagaatgcaccttttatgaatatgacagttacggatggcaatggaatcgtcaacggtcagccggtgaaaaaaggagatcatttcatacttccaaatggcttcggaaacgtggaattgcagggcagcatgcagatcattgcctccacgatataaaacaaaaccgttatttgctttcagaggaagaaactgctataatgtgcataagcaatgagcagtgccagacacgtaagaaacagcatctggctgtttacaggcaggatgctgtttattgcggggtagaagcatgtagatcaaaattccccagagaggaaatacacagatgaatcaggaagaaagacgagagaaacgaaaaaaagatacacagagtgcggtcatagttgtggcagtattttttatagtacttgcagttttgatcggaggaattgtgtttgcagtccataaatttgtaaaaccgggagcagataaaccggaaaagaataccgagagcgtgacaacagaggcgacagaagaaccggaaacaactccggtaaccgaagtcagcgatccgttgatggatcaggcaatgcagattgctgctggcatgaccttagagcagaaagtagcgcagatgttcatgatcacaccggacgcactgaccggagtggacggagcaacgatggcaggagattccacaaagacagcctacacgcagtatccggtaggtggtctgatttatatggcaaagaacctgaccggaaccgatcagacggcacagatgcttaccaatatgaagagctacagtcaggaaatagtaggaattccagtgttcctcggtgtggatgaggaaggtggaacagtagcaaggattgcatccaacagtgcttttggagtgacagatgttggaaatatgagtgatgtaggagcgaccggggattcccagaatgcatacaatgcaggaagtacgatcggaacgtatctgaacacacttggttttaatatggattttgctccggttgcggatgtgttgacgaatccggataacactgtgatcaaagaccggtcatttggttcagacagccagcttgtggcggatatggtctgtgctgagatgcagggactgaacgaacaccagatattaagcgtggtaaaacattttccgggacagggagctacagcaggggattcccatgacggggcagtttctacagataaatctttggatgacctgctggcaaatgagcttgttccattccagcaggcagtgaataacggagcatcttttgtgatggtaggacatatttcagcaccagctgttacaggggatgatacgccggcttcgctttcctctgtcatggtgacagatgtgcttcgcaaccagcttggcttccatggtgtagtgatcacagacgcaatgaatatgggggcggtcaccggaacatacagttctgctgatgcggcagtgacggcaattcaggcaggtgtggatatgatcttaatgccggaggatttccaaagtgcatatcagggtgtgatggatgcagtggctggtggaacgatcacagaggatcgtatcaatgaatctgttgcaaggatcatcaaagtgaaacttacaatgtagtataataacactttactttttgaaattgttatgttattctgtgactatggtgcggtaagtgtaccatagaaatattttttggaggtacttttcaatgaacaaaggtacagtaaagtggtttaacaaccaaaaaggatacggattcatctccgacgaacagggaaatgatgtattcgttcactactcaggtcttaatatggaaggtttcaaatccttagaagaaggcgctgcagtagaatttgaagttgttgaaggtgcaaaaggaccacaggcaacaaacgtaacagtagtaagataattttattatcgcttgttactacagtctaaatcagtagtttcatgtacctttttctttattaaatagaacttgttttatttttctagattaagatattgcaaacaatggatttgaaaaagagtgtcggttttccggcactcttttttgtatacataactaaaaaatccatgcaaacagtcttgaagaatctggaggggttctatataataaaaaaagagatagacaatgtcaaatttccgaaattaaccaaccgtgtgcactatctgaaacatgaagtgggaggcgtaaacgaagtgtgtgaaataatgagaaaatattcagaagaagtcgcagaaaaagcatatcagcagggcgaggaagccggcaaagaaatcggtcaacgccacaccgccatcgccgaactccagtccgaatccagataacagaaaaacataaggaaacatgacaaagaaaccattttttaaaggatggtttcttttttttaagttcatttaaggttcgcctgataagatatgcgcaaaggaaaggagacacttatggcagatcagatgatatttaaaaggtgtgagatcaaatatatgttggatatcacgcaggcggaactgttaaaaaatcaaatgaaacaatacatgactgcagacgagcatggaatgagtacaatatgcagtctctactttgatacaccggactatctgctgatccaaagatcaatggaacacctggtttataaagaaaaactgagattgagaagttacggcatggcagacaaggacacgaccgtttttgtggaactgaagaagaagtatgagtctgttgtatacaaaagaagaattgcaatgacggaggacgaggcagaacgttacctgctttttcacgaaaaagtaaaagacacacagatcaccagagaaatcgattactgtctgaaaaattataaaaagctggctccggcagtgatgctttcctatgagagagaagctttttatgcgaaggacgatcacgagttccggatcacgtttgatcagaacattctctggagaaattacgatctttctctctgtaaaggaatttacggagaagcaattttagataaaaataaagtgcttatggaagtgaaaacggcgggcgcaataccgctctggatggttcattttctgacagaaaatcagatttacaaaacgtcattttccaaatatgcgaccgcctaccgcacgatttatgcgagagagcagagaagaagctgtccaccggaaaatttctttgtgtttaccggagatgaggttgtgcagcaggcaataaaatgttaaaaaagaaatggagaaattaatatgttaaacaatttatttacaggaatttttgatacagcaggtgcggcggtgatttccgtgccggattttttgctctgtattgtggtgtcactgctgatcggggcattcatcacatgggtttacacttataaaaaccgctatacgacaagctttgcagtgacactcgcaatgcttccggcaatcgtttgcattgttatcatgatggtaaacggaaatgtaggtgccggagtggctgtggcaggagcattttcgcttgtacgtttccgttctgtgccgggaactgcaaaagagatcggaaccatttttcttgcaatggcggcaggactgatcgcagggatgggttatcttgggtttgcagtactgttttcgctcattatgggagccgtgatgtttgtgttaaatgtgaccggattcggtgtaaaaaaagcagaagtaagagagaaaacacttcgtatcacaatcccggaggatttaaattacggagcagcatttgatgatctttttgaaaaatatttatcatcctgtgaagtagtcgctgtgaaaacctccaatatgggaagtctttacaaacttacctatcatgtgacgttaaaagacaatgcggaagagaaaacatttctcgatgaattgagatgcagaaacggaaatctggaaatcagtatgatgagacaggaggcaaatgtcaatgagttatagaagaaaaaaactgctggcgttgttttttgccatggcattatccatgacggcagtggcaggctgtacaggggcaaagagcagtactggcaatgttgtttccttggaaacagaaacaaatgcagaagaaacatcagcacagagtgaagcaggaactttttcaagtgcagatatgtttactgagcgggatctggcaggaacctatgaggagagtggggcagtttatgtcacactttccgatgatggtatcgcgggggaaacggatggcgttgtgatcgatggacagatggtgacgatcacggcagaagggacttatattttttccggaacactgtcggaaggacagattgtggtggatgcagataatgcgaaagtgcagatcgtatttgataatgtggacattacctgtgcttcaagtgcagcagtgtatgtaaaaagcgcagagaaagtatttgtaacgcttgcagaaggatcgcagaatacacttcgcaatacggatgagtatgttgcgattgacgacaacaacattgatgccgtgatttttgcaaaatcagaccttacgttaaacggcactggaagtctgacgatcatatcagcagaaggacatggaattgtatccaaagatgatctgaaaatcataggcggtacatacgatatcacagcagcagggcacgcattatcgggaaaagacagtgtgcgtatcgcagatggaacctttattttaaccgcagaaaaagatggcattcatgcggaaaatgcagatgatgaagaaaagggctatatttatattgcagatggtgattttacgatcacaagtgacggcgatggcgtggacgcttccaatattgtgcagatcgaggatggaacatttgacatcacagccggaggcggcgctgcaaacagtcagaaaacacatgagtcagatatgccgggtggaccgggtggcggaatgccacaaaacggcgagaaaccggacggagaaagcatgccacagatgggggaaaagccggacggagaaaatatgccacaggataccacaactgacgagagcggcaccagcacaaaaggaatcaaggcaggtggcggcatgtacttaaatggaggaacttaccagattgattccgcagatgattccatccacagcaacgcaaatattacgatcgcagatggaacatacacgcttgcgacaggcgatgatggtgtgcatgcagatgatgcactgatagtaaatggtggtacgatcaccgtgacagagagttatgaaggtctggaaggcctggcggtgacaatcaacgatggaacgattgatatcactgcaagtgatgacggtatcaatacagcaggcgagaaaatggaattaaacggtggatatatccacattctggcaggcggcgacggcgtggattccaacggcgatctgacaatcaacggcggtgagatctacattgacggtccgtctgataacggaaacagtgcgatcgattacggcgaccggtcgtctgcgtatgtgaacggcggaacgcttgtggcaatcggcagcagcggcatggcagaggtgatgagtgattcttccaaacagaaggttcttatggtaaaattaggagaacaaatggaagccggcaacgttgtgctgacagacagtgagggaaatgtgatcgtaagttacacggcattaaaaacctatgactgtgtgatcatcagcaccgcagaggtggagagcggagcaacgtacacgctcacaacatcgggaacgacgacagaagtgaccgcagaataaaaacagctgagggcaggaatcggtatcactgtgaaataaacgaaaggcatgggattttgtatgaggttattgcttgcagaagatgaagaggatttgagccgtgcgcttgtcacggtgttaaaacataacaattactcggtagacgctgtgtacgatggtgcagaagccttggactatctggaaaacggtggcaattatgacggtgtgatcttagatatcatgatgcccaaaatggatggtatcaccgtattaaaaacaatccgcagacatggaaattccgttccggtcctgctgctcacagcaaaggcagagattgatgaccgtgtggagggtttagacagtggcgcagacgattatctgccgaaaccattttccatgaaagagcttttggcgaggatccgggcaatgacaaggagacagacggacacgaccgataatgtgctgacatttggcgatattgcactgaaccgttctacctatcagctcacaggaccggagaatccagaaggtatccgtcttgctggcaaggaataccagatgcttgaaatgctcatgtctaatccaggacaggtcatttccccggatctttttatggataaaatctggggctacgattcagaagcggaacaaaatgtcgtatgggtatatatttcctatttgagaaaaaaattaacctccattggaagtcaggtgaagatcagggcggccagaggacttggatattcattggagaaagacaatgcttaaaaaattaagaagaaaatttattgtaattgccatgctgtctgtttctatcgtgctgatcgcaattgtcggtacgatcaatattgcaaactacatcagtaccaatcaggcgttggatgcaagactctccctgatcgctgacaacggaggtactttcccggatatgacacccggagattttggaaaaaaattggaacctaagtcagatcagccaccggcaatgaatgacctgcaaaagcatgggatttcgcaggaaagtccgtttgacacccggtattttacagtgacgatcgcaccggacggtacggtggaatatgtggataccggaaaaattgcttccatctcagccgggacagcggaggaatacgcagcggagctgtggaaagaaggaaagaaaaaaggctttttggctgattataaataccttgcagcggacagtgacggctcgacgatgtatgtatttttaaactgtcagcgggaaatctctaccatcagaacgtatgttctcgcgagcgtgggaacaggagcactcggacttgtcattgtgtttgtcatgatctactttttctccggaaaagtgttaaaaccggtgtcagaaagctatgagaaacagaaacgctttatcacggacgcaagccatgagatcaaaacgccgctcacgatcatcgatgccaacaccgaagtcatagagatgatggagggggaaaacgagtggacgcagagtacgagaaaacagattgcaagactgacttccctcacggaaaaactggtgtttctctcccgcatggacgaggaagggacaaagctggaaaaagtgtcattttcactttcggatgcagtgcttgataccgcagagggattccactctgtcgcaaaaacaaaaggaaaacaatttgagatcaatgtggcagagcatgtggaatatgtcggcgatgaaaaaaatatccggcagatgatctccctgcttttggacaatgcaatgaaatattcctcagagcagggcatcatccgcatcgcactaaaaacttccggaaaaaacaaaatcatcaccgtgtggaataccacagaccagatcgaaaaaggaaagctggatatgcttttcgagcgtttttaccgtatggacgcttcccacaattccaggaccgggggctttggaatcggactttccgtcgtgtatgcgatcgtgaaagcacacaagggcaagatcacagccaaaagcgaggacggaaaatcaatcttatttaccgtggcattgtagcgtctggcttccccctctctcccggcttttgtcaaagtgtaaagctatggaatagataaaagggttccttataaaacttttgtgagaattgagtgctttatcagtgttcacattttgactttaagtttatgtacattcatcaatggacagtccacgcaatgtgtccgtctgggacacacttcctttatctgtatctagcgcaagtaaatgccggaatcagcatcctttattgcaggtcaaaaatcaaagaaagcctgagtgatttttgacctgctcatctgctgattttccggcatgtaacttgcgcacgatacagataagaaggaagtgtggccgcagacgaacacattgtgcggactgtccatttctgaatgaatataaacaatcaaaaaagtcaaaatgtgaacactgataaagccgcaattcgagcaagttttataagaaacccttttatctattccataatgaaaaccaagtaaaagccgggagagagggggaagccagatgctacaattcgtcaaatgaaatctgatttttcgtcagaaagcgtttgaggagtgtgtcccactcgtgctcaagagttttgtcggtcgagaagatccggtaggagatacccgtggtcacggtcagttctccattctggaagcggatatttaagaacactgcggaaatatcattttccgtgaaggaacttccggtctgggagagggtgcgtttgagattttccggcgataacaggagggaaaacttgaaataggaaggagttttctttcctttgatcaggttgaagcaggaactgcgcaaaagaccatacggaacaaaggaaagcccggtaagattctgttcttcgagttcttccaaggtgtagaagtctttttgcagcgtgccgtcgatatggcaggacacattcgttgtgatgacagcctcctgaatgagaaagtggtcaaacacatcctggcacagtaatttattcataaagtctttgacttcggcaatttttaaagcaatcataaaatcctcccaaaagaaaatggtatcaacataaatttatcattggtttgttttcttgtaaataactgaaatgacaaattagagaaaatatgctagaatacagaggatttgcgaatgcaaaatacggaatgattatacagatttgcagccgcagataaaaagtctgaggtttgatggaaaggttggtaacagatatgacagaaacagaaattttatttgatttactggaaaaaggaatctcaccggcgcacgcagtgagcgcatgcgaaaaaagactgacagatgccggttttgaagtggttgattatggtacggcatggaacttaaaagcgggtggaaaatatgtggtaaatcatcatgaaacgacattgtttgcattcacattaccgcagaattggagtgacagagagcctgcaatccgcattgcagcagcacatacagatttcccatgcttaaggatcaaaccgtcctgcgatattcagacaaacggatacgcacaggtgaatgtggaagtttacggcggcgcaatcttaaatacatggctcgaccgtccactcggtgtagccggaagagttgcagtgcgcagtggggatgtgtttacaccgaaagtggtcacgttccagtctgaaaaaaatcttatgaccatcccgaatcttgcgatccacatgaaccgtgaggtgaacaagggcgtggaattaaataagcagacggaactgctcccaatctgcggactttccgatgatgcagactatttccttgattttcttgtaaaagagcttgctgtgaaaaaagaggatattctggattttgagctgaccatttataataaagaaaagccggagtttgtgggattaaacgatgagtttatctctgcatccagactcgataacttaaattcctgttctgcactggtgtctgcgatcatcgacagcgacagggcggacggcatgaatctcattgcactgttcgatcacgaggagatcggaagccgttccaagcagggcgccggttccattctgctccatgatatgctggtgcgcattctgaccgagtgcggactggaaaaagaagtgtggaacagactgtacaacagcatgattttatctgtggatgtggcacatggacttcatccaaactatgccggaaagatggatctgaccaacaagccggtgcttggaaaaggattctgtatcaaggaagcatgctcgcagtcctatgcgacagactgtggagcggtcgcagtaatccagcagatctgtgagaaggatcagatcccatatcagaaatttgtgaaccgttcggatcttgcaggaggcggcacattaggctcgatcgcatctgcattgcttccggtaaaaaccgtggatatcggaatcccattgcttgcaatgcattctgcaagagaactgatggcagcagcagaccagcaggcattgaaggatctggtgagcgcttattttggctgaaaggcaaaaaagatacagacagcatgaagtatgcatttgacaggagaatcaggtgagaaaaaaatttttttcctatgtggcagggagtgcggcatgtgcagcactcattctgctttcggggtgtcagcagacaacgaatcaattatccaatattacccgctatgtggaggagaaaattgcagaaggaaaaaacacggaagtaagggatacagtgcatgagacggacactgaacaggcagcagtttccggggaaacagagaagcaggcagagccatccgttgaaaggctgtccgtggactgttatgcatatcagacgcttccggaggaagtacgcactgtgtacgatgaggtttatgatgcgattctctatgaaaaagaagatgtggcgctgagcacgttagacaacgaagtcctgcatcaggcgtatgtttcggtgatggcggatcacggcggactgttctgggtatcgggctacacttacacgcagtataccagaggggaaaagctggtggatctccattttacaccaaagtttaccctgacggatgatgagcggatggacatgcaggcacagatcgacgagacagtcagtcagattttggcagggatcgatgcggaagcgccggattatgacaaagcaaaatatgtgtttgattatctggcttcgaatgttgcgtacagcacaggtgcgccggacaatcagaacattatcagtgtgtttgtcaatggggaaacggtttgtcagggatacgctgcagcaacgcagtatcttctggaaaaactggatattccctgtgcagtggtggccggaacggcagacggacagtctcatgcatggaatctggtaaagctggatggagagtattattacatggatacgacatggggaaatgccacctacagcggtgatggaatggggctggattcctttatcaattataattattttgcagttacgaccggggaattacagaaaacgcatcagccgaatgacgatattatcgttccggtgtgtcaggcggtaaaagacaattattatgtccatgaaaatctttattttgacacatgggatgcagacaacatcggaaatgtatatcggactgcctatgagcagggagatggtttctgctccgtcaggtttgcagacagggagctgtatgaacaggcattctcctactttatcacggatcagaagatcgtgcattactgcaaaggactgacatctttatattatctggaagattccgaccagaacgtgctgactataaaattttaataaaaaacataatatcctctatacaaagtaaagtttttgtgttaatgttacgtagtaataaatactacatgtaatagaaaaaagaaacttttgatataataatgaatatcacaaggaggcaaaatcctgcacagcttgctgggcattgctccatgtaaggacagtcgcattttgcttcgcaaaacaaggaggatttatgtataagattgtaatcgacagttgtggggaattaccggaagaattaaaacaggacggacattatgagaccgtttcattggagctggaagtagacggatgccgtatcagggatgacagcacatttgatcagtcagattttttgagaagagtcagagagagcctgaaaggaccaaagtcctcctgcccgtcaccggagcagtatatggatgcttatgagggcgaggcagaccatgtttatgccgtgacactgtccggtggtttaagcggctcttacaacagtgcagtgctcggaaagaatctatatgaggaagagcacggagatacaaagaaaatttatgtgttcaattcgagatcagcgtccatcggtgagacaatcatcggcatgaagattcaggaatttgaggaagccggatgcagtttcgacgaggttgtggagaaggtggaagagtacatccagtccatgaacacctattttgtattggagacgttagagacattgagaaagaatggcagactttccaatctgaaagcatttattgccaattcattaaatatcaagcctgttatgggctcaacaaaggagggcttaatctgccagttagatcaggcgcgtggtatgaacaaagcacttgagcgtatggtgaaggatatgatctcaaagacaaaagactgtgagaaccgtgttctcgcaatcgcacactgcaactgcccggagcgtgcaaaagcagtgaaagaaaaaatcgagaagattgcgaagttcaaaaagatcatcatcatcaacaccgcaggtgtcagcagcatgtatgccaacgacggcggtgtgatcatggcagtatagtcagatgcagacattaacttacgaagaaacagtaacagcgattgaaaataaaagaagatttggaaacttaaagggtgtcgagatctcaaagataatgttagagaagttaggacacccggagaaagatttacgcatcatacacatagcagggacgaacggcaaaggctccgtctctgcttttttgcgctctgtttttgaatgtgcaggattgaaaaccgggatgtttacttctccacatctggtggatttcagggagcgcatccaggtgcagggagatatgatctcaaaagcggataccacgcgccttggaaacaggcttctctctatggattttggcgtttatccgacgatgtttgattactgtcttgcgatggcattgctgtattttaaggagcagcagtgtgatgttgtgattttggagaccggacttggtggaacgtatgactccacgaatgcctgcggtgtgccggatgtgactgtcatcgcaaaaattggttttgaccatatggcgatcctcggggacacacttgccaaaattgcggcagagaaagccggaatcgtcaagcacggcacagcacttgttttagagagccaggagaaagaagcgatggacgtgttaaaacaggcggcggagcgggcagacatcaaaaccacaaaagttgtaaactgggacgaaattaaaatcctgccacaaaaggacggaaaacagtgtttttcatacgctggatacgatgcagtcacaatgaaaatgctcggtgtgcaccagtatgaaaatgccgtggcggcaatgcttgcagcagaattattttttgaaaaatattttgcaggaaaaaagaatgtgccggaacggaaagctttgcagcatgcaatccgggaagggatcgaccggacacagtggatgggacgcatggagcttgtgagcaatgatccgtttttcctgatggacggtgcgcataacagtaacggtgtggaggcgctgaaaaaaagtctggagacaatgtatccggatgaaaaattccattttatcatgggtgtcatggcggataaagattatggggagatgatccgggaacttcttccgctggcactggattttaagacagtgactgtggagagtgagagggcattgcagggagaggcgcttgcagactgcatccgggcaaaagggatcccggcggaggcgtatcagaaccttgcggatgtgctgccggatttctcaaaatcatccgcagaaaagacagtggcattcggctcactgtattttatcggggagattgaagcatttctgcggggaaaacagtaacatggtttccggaaaatctgagaaaagcagcgtccgtgcccaatcattacagaaaagttacaaaatagcatggatttaatatatttttaaaattaatcatatagcaatatttatttttttcatctataataacaactgtctgtgcatataataagaaaagaaaacaggcagttatttttttgaaaaacaggtagagtttctgcagaaaagcacgttgatcgtgcagcacaagcaggagaatgagagaaagaattacgtatggtatttagcagttttgaatttttgttccggtttctgccggcttttttaatcatatattttatcacaccgaagaagttccgcaatgcaatactctttttggggagcattgccttctacacctatggtgaggcgcagtatgtcttgttgctgttagcgtcagtcacggtgaactatgtgatcgcacgcagcatgtataaaacaccggaggacggaagaggcagaagacaggcagtactgcttattctggcactttgctacgatttcggaatgctatttttctttaaatacagcggtctgaccacgaagctgccgctggggatcagtttttacaccttccagatcgcagcgtatgtgatcgatgtgtaccgtggcattgtcccggcagaaaaatcttatgttaaccttggaacctatctgacgatgtttccacagctgatcgccggaccgatcgtaaactataccgaggtgagcagctgcctgaaaagaaggacggtgacagcacgggattttgagagtggcgtccgtatccttgtgatcggactcggatccaaagtcattatcgctgaccgggtgggaatgttgtggaacaacgtgcagacgatcgggtttaacagtatctcaacgccgttggcgtggctgggtgcggtcgcatattccatggagctgtattttgatttcgcaggatattcgatgatggcgatcggactcggaaaaatgttaggattccagattccggtaaacttccgttttccatatatctcaaaatcagtgacggagttctggcgccgctggcacattacactgggacggtggttccgcgattatgtatacattccgctcggaggaagccggaaaggcagactgcggacgatgttcaacctttttgctgtgtggatactgaccgcgctgtggcacggggcagggtataatttcctgatctggggcggcatgctgctcggggctttatttctggaaaaattgtttttgcttccatttttacagaaaagcaaagtgatcggacatgtctatctgttactgtttgtgcctgtgacctggatggcatttacgatcacggatgttcaacagcttggaatttatctgacacgtatgtttccgtttgtgaatgcacataccggcatggtcaattccatggattacatcaaatatctgaaagattatgacagcctgctggcgatgggagttctttttgcaactccggttccggcggtgatttatggaagaataaagcgggggatgctcggtacgctggcaattgcggtgatctttgcactcagcatgtactatcttgcggtatctgcaaacaatccatttttatactttaatttttagataacaggaaggagcagaaatgaaaaaaatcagatattgcaaaatcaccattctgattttagctggctgggcaatcctgtcagcgataggatttctgggaaaagatacgatttacagccgttatacggtcgatccggtaaaaacaccgtactttgttctggtcatgcagggcatacacgatgggatttacccatggagcagcgaccatgagtcactctgggataaatgggaacatctggcagaactgagaagagatgaggagcagatatccgcgactgagagcacagaacctgccgcagagggaacggagagtatggcagaaacggagacagtggcggagacagagcaggaggaagtaagaagctttcatgcggtggacgccgggtacttctcggacgcagtgtttatcggtgactcgagaaccgtgggacttcatgattacggcggactcgatgacagcactttttatgcgaccgtcggcatgaacgtatacaacctctggacagaaaagttctgtgaagtggacggggaaaaagtgacattagaggaagcgcttaaggcaaaaaaatacgggaaaatctatttccagatcgggatcaatgagatgggaaggggaacactggatggtttcatgacagcctatgaggattcagtggaaaaattccgggaactgcagccggacgctgtgatcttcgttcaggggatcatgaaggttgcaaaagaaaaaagtgataaagatccgatctttaacaatgtggggatcgagcagcggaatgagcggattgctgcactcgcagacggaaaaaatattttttaccttgacatgaatgaggtcgtatgcgatgaggaaggcaacttaaagagcagtctgacgttcgacgacattcatctgtatggttcaaaatatgggatctgggtggattacctgaaggagaatggaatctgaaaaaacgctatggtgcaggaaatagcatcatagcgtttcttttaatcgtttttctcaaaaatcgtgaaggtatttttgttgaattccaaaatgccggcatctctcaatttgcacaattcattggacatggcagagcggtcgacagagagatagtcggcaagctgctggcggttgaatggaatggtaaaggttgaagcattggcttttttcgattccatggacaggtaggagagcagtttctctctggtggtgcgcttggacatatgttctaacttgcggtttaactggaaatttttccgggacactaacgttagaagattgcggatcagccggttgtgaaacgcacaggcggaggggcagaccgtcaggatcttagagacctccagaaacaaaacgcggcaggtggaagcagcaaaaatattcatttccagcggttcggtggaattgatcgcataggcttccccgaaaatatcgcccgggacacattctgccatcagattggcattgccccagaagtcctcttttacaatgtgtacattcccctccagcacaatgccgatgcctgtgatggtttccccataggaaaaaatgatctcgtctttgataaatgtcgtctcccgtgcagagaggcaggagagcatgtccctgatctcatcggttgtgatccctgtgaatacagaggtctgtaataaaagcagatcgtcgtttgtcatagaaactcccttcaaatgtatgttcgtagaataaaacataattacgttgtaaaaacaacagaaaaattttctttattatattagtatgcacatagaaagtcaaatgaaacaaataatagatatgcagacaacaggaggaatggaagatggtaagaagaattatagagatcaacgaggaagcgtgtgtaggatgtggtctttgcgcagaggcatgtcatgagggagcgatcgcaatggtgaatggaaaagcgaagcttatgcgcgatgattattgtgacggtctcggcgactgtctgccggcctgtccggtagatgcgatccattttgtggagcgtgaggcagcagcttatgatgagaaggcagtggaagaacatagaaagagcaaagaggcggcaaagacaccatgcggatgtccgggaagtcaggcgagagccatccggagagaggcagatgcagacagaagcgcagagctgcagacggcaggagaaatccgttccgaactgacacagtggccggtacagatcaagcttgcaccggtccgtgcgccatactttgacggcgcaaagctgctgatctcagcggattgcagcgcatacgcctacggagatttccaccgtaaattcatccgcagccatgtgacactgatcgggtgtccaaagttagatgatgtggactattctgaaaagttgacagaaattatcaaaaacaacgacatcaaatctgttacaataacacgtatggaagtgccttgctgtggcggaattgagatggctgcgaaaaaagcattgcagaacagtggaaaattcattccatggcaggtagtgaccatttctacggacggaagaatcctggaataacagtaaaattctgcggttgcctccatttataggagatatttcgaaaaaaagaaagagaggacgaaaatatgagtgaaacaagcgtaaatcagagaaaagtggcaatgatcggatgcggttttgtaggatctgcaacagcatttgcattaatggaaagcggtctgttttccgagatggttctgatcgatgctgataaaaacagggcagagggagaggcgctggacatcagccatggacttccttttgcaagaccaatgaaaatctatgccggagattatgatgatattgtggatgcagcgatcatcatcgtgacagcaggcgccaatcagaaaccggatgagacaagattagaccttgtccagaaaaatgttggtattttcaaatccatcattccggaaattgcaaaaagaaactgcggaggaatcctgttgatcgtttccaatccggtggatatcctgacctacacggcattgaaattgtccggtttcccggaaaaccgggtgcttggctccggaacggtgttagatactgcaagattaaaatacaaccttggagagcatctgaatgtggacagccggagtgtacacgcattcatcatcggcgaacacggcgatagcgagcttgcagcatggagcagcgccactgtttcgggtgtgccgatcaatacattctgcgagatgcgcggacacttcaaccatgacgaagcgaccgagcgtattgcagagaatgtaaaaaacagtgcttacgagatcattgcaaagaaaaaggcgacctactttggagttgcaatggcagtgcgcagaatctgcgaggcgatcatccgcgacgaaaaatccattttaccggtatcgaatctgatgcacggagaattcgggatttccgatatttccttaagcatgccggcgatcgtgggagcgcacggtgtggaaaaccggatcccgatcgctctcgatgaggaggaaacagaaaaactgcaaagttctgccggcactttaaagaaaattattgaagaagtgttataaaaaatgatagaatgaaagaaaaagccagacatattttgtgtttggtttttcttaagtctggagagaaaaacatggaaaaaatattaatctatcaggtaaaagaaaaagaagcggtaaaacagctgcttgcgccaatgaaaatccgcctggaggagatcaaaaccacagatttgcggcagagtatcggggatctcgcagagggaaaaaagaacgtgctcacagcaccatttagcggcagcgcaccacaggagagccttatggtattctgcggtgtgaatgaaaagcattttgacaaaatactgtttgaactgcgccggaaacagattccggttgactataaagcagtccttacaccatcgaaccggaaatggagtgtgcttatgcttatgctggaacttacgaaggagaaaaacagcttccggcagggaaactgaaacggaacagggacagatccgaaacggaaatggacaagcgtgcagattcttgtatgaaatgtaaaaatatggtaacataatgatatatgtctgcgtgcagagacagtatctgacggcagactgcgaatggaaatacgatatttcacacgaaggagaatgaaaaatggaacatttcatgaatctggtgttgatcaaaaatatatatattggtattccaatggctgcactcatatgctatctgtttttactattctgttttctgaatgttgcagagaaatcatcagaagtaagagatctcaaggcaatactgtcggcattattgtcctggacaggcggcgctgtgctcatgagactgcagatcagcccggggatacagttctggtatcatgtgtcattgatgggactttttacgatcccgatactgatatatgattttttgttccattatcttgatatcaggggaaaggacagatttctgtatggctgtatggctgtgacagtatcagctgtcctgctgaatgtttttaccggttgtattcttccaccgccggaagtgcagatcatggcgaatggcggtatatcctaccattatcatgcaaaaacaggcatctggttgctggcagcagcagagatatttctgttagtgtatgtaacgctgcttgcccacaaaaaaatcggggaacaattagagtaccggaaaaaactcggcccattattaataggaacactgctcatcatgggtggaaatattctgtgcgtgatgccatggagcggtgatttcccattcgatacccttggcggagtgggaatggcggtctgttttgtatacattatttataaacagtatctgttctcattctccatgcgtgcgacaacaggtgccgtatatttgatcgcagtagttgtagcgtttcttccaatgattattttggagccaaacattgaccatgtgatcggccagacggacagctttaccagacagtttatcacagtgtttgtcgttctgcagtgcctctggatggtgttggtcatgagctatgccagaaaatggctggagcgtatcctgtaccagaagaaaaaacacattgtggagagccttgtggaatttcaggatatggcggcctcgatcctgaataaaaaagaactgtaccagaaaatccgaagcaccgtcagttcggcagtaccggactcgtatgcacgtatttttgaaaaaagagatgaccattttgtggagtgtacggcagacggagaccgggtgctggacacagaggaggaggcaaggctgaggtcattctgcggcaccggcggcattcataaaaaaccggagatcgcagtttttaagtatgacgataaaatttatggatttttatatgtggagcttcacagaaaaaacaggctgatctatgatgaggcggactgtatccggcagatcgggaacagtgtatccggcgcattaaaaaatatcagtgcctatgaaaaagtatatcaggtgtccattcatgatgaactgacaggtctgtataaccgcagctattgcagtgaatttataaaaaatttggacataaaggaacatccgacaggaatgatatatctggatatggataacttcaagttatacaatgacctgtacggcgaggagaccggagaccagatcctgaggtggagcgcatcccaggtgcagaacctctgcagtgacaaaatgtcggtattccgtgtcggttccaatgaatttcttattattgcggaagaaagcagaaaagaaatactattgtcgtttgcgcggctgatacagaatacgatattagaacagaaagaagataagccaaaagtcatccagccgattacgttcagcattggaatcgcatgggacaaaaacatggcagaaagtgcaagaaaattattccgccaggcaagacgggcagccttctatgcaaaaggaaatggtaaaaaccgtatcgagatttacgagaagagttttgagggacaggaacagagcagggagaaaggttatgagcaggtaacgccgacgatttttgcgctgatggcagcagttgatgccaaggattcgttcacctttgaacactctgagaatgtttccgggtatgcgatgaagcttgcagcaaaaatggggcttccaaaggatgatatccagactgcaaaagtggcaggtctgctccatgatatcggaaaaatcggtatcccggaaagcatcttaaagaagaagggcaaactgacagatgaggaatacgaggtaatgaaaactcatgtggagaattccattgagatgatccatttcctcccgaatatgaactatgtcattccggcggttttatcccatcatgaacgctatgatggaaaaggctatccgggcggtgtcaagggaacggacatcccgcttttaggcaggatccttgcagtgtgtgacagctttgatgcaatggtgtccaggagggcttataaggatgccttaagcgtggagtatgcgatcggggaattagaaaaaggaaaaggcacgcagtttgatccggatgtcgcagaagcatttattgaattgatcgaggaagatccttcgtttcaggtgaaggcttcgtaatggcacaaaaaagaatgttaataatgcaaatttaggatctggagatttagatagtattatggttataaatggaggagtaattcagtttaccgatagtgacagagagaattttacagtaaaaaatatacagatgaagaaataaagtgtaattcagaacaattttagaaaaatttttagcaataacgctggtgttggtgttcatgacaggttgtgggagtgcggctgacaaagaaattatgacagcaaaagagtttcagaaaaaatggaagggatggaactgactgtagaggatcagacatcttctgccacagattcaacttatcatgattatgaattagaggcaaaagaaaattattgatgagttaggggattaatatgtttgggtttattaagaggaaatgtactgcagaaacacttggaacaatagtaaagaagagatggaatggcaatttatggtttattacagtcgagtatttcgtggaaggacaatcatatatcgtcaaagagcagctcacttatcatgttgagaaaaaatataaagttggaaaggttccagtcggaatgcattctacatcggcacttaagagtattgacattaatgccagcgtccgtgttaagtacaatccgaataaacctaagcagagctatttgccggataacaatggacttcatttgggatagagacggtgtttgataatgaatgggttatagattattcggcttcagaaaaaatcacattatctggaatatggcttttagaaaatgggcaattattagagctgttaaatttgggagaaaatacaatgaaaaaacttgaaataaaaaaaacagaagcacggaaaatacatatcaagaaggtattattggattctaatttcagaataatgaatatcatttcacttgttgcatttattgctatggtatacggcattattcgtaatcagaatgtgacttctgatgatacgttggcttttgccagtaatttagactatataatcataccattattaatctggtttgtatttacacttatcgtctactttacaagtggtgcacatgtgtcagatatgtttagtgaagtattggaagtaaatgatgaagcgtttgttcattcgaagaatgaggcaaaaggcggcggttatatggcagatattgagggtaatgtcagagtatatgatattgtaaaatttgcagatatacaatcatgcaaatatgataacgtaacaaaacgaatagaaatcatcgcccctgaacttgaagtaaaaaaaattggagatagtataatagggcaggagtatgtagaactaaataagtttatcttctatgattattatgaaccgaattttttagaagaattaaaagcaaagaatatttcaataacagaggaacgtattaaatatagaatcaatgaaatgccagatgaatacaggggattcggtggagataagagatttattgaggacgctaaaaatgggaggctgaaaaggttttgaagcaaggttcaaggattattatttttatcgcattagtggtagtattgggaagtgttggctgtttcttatattatacaatacgtttcaatgtaaggaggacagatgcactaaaccagacacaggagatagcagacgaactttatccaatgattgtagagcgagactttgatggaatgacaaagtattttgcaaaagtagatggaacacctgccacaacagatgaagtagaacaatatgttacatcaatggatgaagggtctttttttgaaaactacacagaagaagatcagccgatgtttcatgtctatggtgatacaaattacagacaaatgataatcgaaatttgggatgtggatgaggagtccaaaacccatacactaacattttatttatataaaatagataaactgtggaaaatagttttggaggaataacgatggaagaacaggcaaaagaatatcagatacaaatgaaatctcaagctggtttgataagacaggtttctctattatagcaataggttaaggagatttatatagtattatggttataaatggaggagcgattcagtttactgatagtgacagagagaattttacagtaaaaaaatatacggatgaagaaataaagtgtaattcagaacaatttttgaaaaaaagaaaaaaaaggagatgtgtttttttaatcatattaatggtgctcgtgttaataaggtgtttggcttggaaaatcagatgtgttatagacattgcattgttattttatttttttgtaactattatatgtgagtctggggacaagacaaatattaaagcagccaggagagcatattatattgaggcggaagttgtgaaaattttaccagaagagagacatatggatggaacgttgacatcaggatcagatctgtccattttttatccgattgttggaagagatacaacaattgggtatgagagtatctattatttaacacaagagcagtatgatgatgcggtaataggtggaaaagtaaggataagtttaaaaggcaaataatgaaaaagagcaattgcgtacaggtaagaaatattatttaaagagagatgagcaaaacgaattgatttaaaagttggatttggcagttagcttttgtaaatcggaaagaatgggaatttatgacatagcaaagctgacgtaagtccagaacctacgcaaatggggagatatgaatagctctttattatgcgattcgctttacagctttaagcttacgataggattgccctgtgccggtggtgattgccgcaacagcaaccgctaacagacttatatgggcaattgtattcaagttggtaacagatgatttatttcttacccacatacgttcctgccctgtatttttgaaacgtgaattgtatctttcacattctgtacgaagagagtaattacttttgaaatatttgctgtctctgtcgacggagagtcttaaatcatcgggaatggtgatgtattttgtacagccgcgatgcttcttgccgttgtaaaaatttttgtgatggcagggacaatcagcgtctttgcttgattttagtgggcagcagaatttttggcgtgtacgtccattatcagaaaatttaccatccttccacatggcaaacccggcatcgcagacaggatttccctgtggaagaagttttggatttttggtggatcgtttgtttaatggaataatacattcgccttggtagagttcctgtacctgattatagatttttttaccatcatagcctttatcagcaagaaaggtacattcggttatcggcagaaaggtatgtgtgtcagccaaaatatcaagcgcaacagtggaatcatggacattggcggtagtggtcagttcataaatgggaagacctgaaatacagtcaacaaggacgtggtttttgtaaccccagtagaattcatactttttctcgtttgtttggttagaagcagtatgtacgccaagtttgcaatcagtatctgctttgggctggttatcaggcttaaatttgttggagagaaaagatttaggattattctgtgaagtgtttgcagcaatcggagtagagtccaaaccaataaaagatgtatcaacaataccttgttttgaaagataaagaacttgggatttcataatggatgaaagtacatcgttatcaagctgttttagaaaacgatcaaacgtccagtaagaaggcaacggagcagaaatatcaaaaccgcagtaatgggcgattagaaggttgttgttaagataatcaacaagatccgtaatcattgaaaagccttcacacttcataacgataaacgaacaaatcatggcatgattggaaaagccttttcgtccggttttagggaattcatggacaaaggataaatcgagattcagaaaaagtgaatcgtaaaactttgcaactggttgtgaagtgaaaagacggatgtctttcaaaatttcttgacgatagataacaatcagctcctctcggtgaattgattttgacaacttaattataccatttggagctggttgttactataaatttggagtgataaaagaggttgccatgcctcgcaaacatgcataaatactgagtatgtggagttttgctcatggctattatttaaatagtaatgaggtgacaattggaaaaagacagtacgggattgaaattgcagataatccagttgtaagcaaacatcatgcaatgcagtctggaggagcaatcgttttaattgtctttttttattgcaggaggagtcggtggcatatcagtatccattttaggcttagtggtatacaatttgaccaatacaggtggaaagaaatagaaatggtaaaataggtatgcgttattaatgtgaaaaagagtaagtagagcaaaagaaaaatgaatatatttgaagcgtccataccattgtctttaaagagaatgtcgagaccaatataaaattagatggtttggaaaacaagatgagagtagatttttcatccagaaatccatatagcgatggtgcagaatggaagtggagattaaaagataaggatgatcatgtaatagaaggtgcaagggaaaggtttggtaaagtaggaaaagtaataggggaagattttggaaatatcaagggcaatgtgggaattgaaatgaataaaataaaagcctattgcaggtcgtttagcggaggcagttttaagggaaatgctataaaaattttaaaagatagtggaagtacaattaagactatgagcaaaaattattttagaaatgatgatggtgttttaaaacatataaaaagtgtgttgaaacctaatgtatcagcggtgtttgcgttttctgatacagtaaaaaaagtcccttatatgagcaccacatgaacactaacgcaatcgcagaagttttctgatacagtaaaaaaagtcccttatatgagagggcaaaataataattttgtaaaaaatctcggaaaaatatcttatgttggaacgcagataaataatggagtaaatgcagcaacacagggattaaatattgctactgggaatgttcgggataactgggatacaacttcaaaatggaataaaatgataaaaggaatagataatgtgtctgatagagaaaataaaacattagatacatatacaattcagacatcaactagatataataatttaaattacatatttaattagattatggaggaagtagaatgcgagaattaaaggtaaataaaaaattaaaaaagaaaattgtcgggtacggatataaaaacacaagagaatggacacaggcaaaaataaagagaattatttttattgacatttttgctgctataccagaagtggcagcattaattgcattggtagatagtttgttttctaatgacgatgatataattttaatagttacaggtgtgtggtgtagtacagcattgataccattgtgtgtagcaataatctattataagataattagaaataattcaagcgtatcatatgagatgtataaagaagaacaacttttttatgatgatgaaggctttacattttcttttacagattatggtggtgtgccgggtaattggacatatcaaattaagtataaagaaatagaagaccttattgactatcctaatataagtatgatcaggataataggacattatccatttgagttatttcaaaatggaagagtatcagtttataacagggaatgttcagatgaaattaaggtttcaataggttattattatgacgcttttgatgagtttaaacgaactttatctgaaaaatcaggattaaagtttgaaacaaaagattattgataagggattgtatatacaaatcatgcaatgtagtctggaggtgcgtatggaaaacaagattgaatttattaataaagtatacatggggaaagaagcgaaaagtgggaaaaaagttttttcggttatagcgggggttttgtttgcaatcgttttaattggctcttttcttattgcaggaggagtcggtggcatatcagtatccgttttaggcttagtggtatacaatttgtctaatacaggtggaaagaaaacaagtacctatattttaacggtagcattttttgaagtggattctgagggagttgtgttaacacattcgttgattgattacaatgacaaattggggatcagggatgagatcaattcaatgaaatgggatgcaataaaaggaatttcctatagtgaagaactaaattcgatatgcattgatggaaagggagaaaaaaagactatctggaaaagtgaaaaaagaaaagaacgttcacctcgaaaaaaagcgataaataggattattctctacctaccatatgatagcaaagataaatttattcatttgtttatgacatatgggaaagaaatagaaatggtaaaataggtatgcgttattaatgtgaaaaagagtaagtagagcaaaagaaaaatgaatatatttgaagcgtccataccgttgtctgccggtatcaaggtggctgaatgtttagattcagccgccacatttgtggcggcttgtttccttttatgtgtcagaagaaatagtttctacttcctgttgagataaacctgaaaattttgcaatctcttctatagtaaatttgttcgattgcagcatccttctggcagtttcaattgcagcatggttttgtccttcggaaaatccggattcacgaccttcagaaaatccagatttatgtccttcggaaaatccggtttcatgtccggatttttcaccatcagaaaaaccggcttcatactcagcctttcgcaatttcttctcttccaattctttatcatattcaaaaatactcatactgataacctccgcacgatttttggaaagaaattctgcaagaatcccttcctttatgcattcgtcaacagcacattctacagcctgattcagagacatgttggcagcatagtgccgtactctggcgacatattgcgcatattctttcaaagtgctgcaatgttacatcaattcagcattatgtccttcgtttacatttaatacagtgacagtcaattcaagctttggttcgcctgacagattttcaaatgctgaagaaagcttaagttcagtgcagtcagacaatatcgttgaaccattataaaactcaataaaattcggcgcaggaattttttgcaaagtagaagaatagagagatttcttatccacgagtttctgatattcgttactaatatagaataaatcccgaagagggatatttggattgtaggttgactggtgctcgtacagatataaattagtatcaatgataaatgccaggtcatttttcatacccatgtaaattgcattttctaatgtgacgatttccaagtcatcaggatttttataatctctctgatttactgcgttgtagagtgaaagcaggttcttacggttggaaaataacatccgaaaaacggtgtccttataattccggttggctgcgggaactttaactgtgaaagttttctttgtgttttgtagttttctttttcgttttgccataaatgattcctcctgagatcggcggggcagttggaaaactgtccaggcaggagaaaactatatttctgatattcgtctcctgcttttaaattagttaatgggtaattaaaagcatagatacgaatgaagtacggagattatcagggataatcagccgtttccagaatatagatggcaaatgcaccataaagattttgtaaaatatgctttctgtcattgtaacatgagagataattgcagacaagaagaattttacaacttttttatgaaggttttgatgattttaaacgaactttatctgaaaaatcaggagtaaagtttgagacaaaaaagtattagagaataagaaaaacactgagacaggagaggtatgcgagtgcagtggaaagattgggaaggatggttgcatagattcgcaggactacacatagttcaccttgaaaagaaaaacggcaaattgtataattgccataggaatcattatcagttccgatttttgcatgattggaactgatataagagtcgaaaactgcaaagaactgcttggtcagcagacactaactacgaacagcgtcaggacgttatcgcttgatatatgaagggtgaggtgcagtattatgagaaacttgagaagaatcacagtaattatggtcatggtatgtcttatgataggacaaagtgggggtgctggaatttttgattcaacaaaaagcgaggttcgcattgcgaaaaaagtattaaagggaaaatacaatgaagactttgaaatcattacactgggaggacgtgggggaacactgacgaatgatacctttactataaaatgttatccggtatctgatcctgactgcatctttaaagctgagatataaaaagaggggagtttttatccgattgttggaagagatacaacaattgggtatgagagtatctattatttaacacaagagcagtatgatgatgcggtaataggtggaaaagtaaggataagtttaaaaggcaaataatgaaaaatagcaattgcgtgcaggtaagatgaaactcaaatcgaatttgcaaatgagaaatttgtgttttatgaataataaaatagaaagtgaaagagatggaatgaaaaagggtatcaatataaaaaatgtaattgtcagtcttgtttttttaatcattgggatagggatgttactatttgtattatttgtggttcttccggcaatgacacataatgcagaagtatgtactttagaagttgaggcggttgttatagagaatgagccttattggacaactactggggatggagagtctgtacgcaggtatagacaaattggtgaatatactgttgataataaaaaaatcacattgacaataacagaccaaaagacagatccagtgccagaaggtacaaaaataacactttgggttaaccctgataatccgtacaattttataaatagcagagagataaacttgattgatattgttgttccgattgcaataccaattggtattatgttatttggagtattaggtttggtttttaatttgaaaaaagaaaaataaaggaaaaggaataacgacatcatggaaaacggtgcaagcttattaaaaaagctgggtattatatttttatgtataggaactttgggtgtttcaggtagtctgattttgtatttcatagtcccatctttgtggttgttttcaattatctttggcagcgttctggcagtttttttaatcgttggaattatttgcatgataatttattctacgaaaaaaggaaaaaaagaaaaattaattgcaaatggaaaatatatttacgcagatattgtcgatattgatgtaaatgtatatcagaaagtacagatagaccgtatttcaatgaatccctattttattgtatgtaaatatgtggaagcaaatggaaaagaatatctgtttaaaagcaagtcacttttatataatccatcagctttgattacagagaagcaattgaaggtttatgtagatttgaaaaatccaaagaagtattgtgttgacacaagttctattctgccggattcagcagttttacataagtttaagtttgatagtagaggaaaagaacgtgctttactgaaagaaggaaattatataaatgcggtaacctgtggggtggaacttgtgggaagaataaaggttaacagtattgtaaagccaatgtttttgaaagttacagatagtttaagtgagcagtttaaaactccggttgatgaaaaaaacagagcatttatggggtatacagtgttatgccgatatgatgcaccggatgggaaaatacatatttttgcatccagagggcagtggggggaacctcaaagagattatcagggagaaaatgtcagagtatattatagtggaaaatattatgaatcttatcatgtagatcttaattctattggtttataaaaattagttttgttgcaaggtaaagtgggtggattttgagtcatctggtacaacatcaaagccgcagaaatcacgcaattgttgcagttgtaggagagaaaataacaggaggtgcatggatgataatagaaaatggtgattcaaaatttacagaggaagaaaagcgaaatcttgttgtacgagaatatacgagtgaagaaatagagaaaaataaaaaagcgtgtgtgaagaaaagcacaaaaaagtgttttccactaatagtcctaatagtgttatgcagtatttgttcttatatattacccgccatgtcatatgcagttgatattgtcatggttatcatcatttttttgtttatcttaacgataatcataaatatattgaattatcggattgcaaaaagatggcattacatagagctggttgtagataaaaagcttccgatagaagcagaaagcagggatgcaggagcatcggatgattcatgcatgatatatcattatccggtggaagggagagacagtacatcgggatatgcaagtattttttatgttggaaaagaaaaatatgaaaatgctgaagtcggggaaaagatcaggattacccaatgttaatatgatagagataaagggacattttgggacagagttaactcgaaatagaacgtctataatgtacaatgaaaatcgtgaaaaggaaatgacaatatcatagttcaccttgaaaagaaaaacagcaaattgtataattgcagaataaacatttgaaagacacggaaatagacaatacagagggagcatgacacatgggacgatttcttaatcctgattacagtgcatttgagacagcgttaaattcagaaatttatattgataaaacaggtttgcttgcgtataccaataaagtgatcaatacaaagcaggcgtttatctgcaacagcagaccgcgtcgttttggaaagtctgtcacagcggatatgcttacagcttattacagcaaaggctgcgattcagcagatatatttgcagattatgaaattagccatgcaggggattttagacagcatctgaacaaacatgatgtcatacatcttgatattcagtggtgccttgctccagcgaagggagcagcaggagttgtttcttatattgaaaaaagtgtcatagcagaattaaaagaaaaatatccggatattatttcggaagaaacggtatctttgccggaagcaatgtcagaaatctatactgtgaccggaaataaattcattgtaatcattgatgaatgggatattttgattcgtgacgaggcaaataacagggacgagcaggaaaattacattaattttctgcgtggaatgttcaagggaacagaacctaccagatttatcagtctggcgtatctgacaggaattttgccaatcaagaaaatgaaaacgcaatctgcactcaacaattttgatgaatttacaatgttagatgccggggcactggcttcttatattgggtttacggagttggaagttcaaaaactctgtgataaatatcataaggattttgcagaggtaaaaagatggtatgatggatacgtgctggaaaatcagcaggtttataatccgaaggcagttgtcagtgtcatgctgcgcggaaatttccaaagctactggtcgcagaccggaacatatgaggttgtggttccactgatcaacatggattttgatgggttaaaacaggcggttatagagatggtttcaggttcgacagtagaagtagataccggaacatttcaaaacgatacggtaagcttttctagcagggatgatgtgataacttacctgatccaccttggatatctggcatatgaccagagaaaacagtgcgcatttattccaaatgaggagatacggcaggaacttttagcggcagcaaagaaaacgaaatggaatgaactgcaggagtttgaatatcaatccgagcagttgttagaggctactcttgatagagaggaaacgctggttgcagattatatcgaacagattcatatggagtatgcgtcagcaattcaatatcataatgaaaattcattgagcagtgttttgacaattgcgtacttaagcgccatgaaatattattttaaaccaattcgggaattgccgacagggagagggttttcagattttgtatttataccgaaagaggaatacagagtagattatcctgcactcgtagtcgaattaaaatggaataaaagtgcatatacagaattacaacagataaaggacaaaaagtatcctgaatcattgttgcagtacactggaaatatacttttagtgggcattacttatgataagaaaagtaaagcacatgaatgtgtgatagaagaatataagagataaaagagttgttattttagaaaggacaccatttagagaatggtgtcttttttgcgtgtagaaaaaatgtaaatattttacccaaaattacatcagattatatggtgtgaattgtaggagaataatataataaaaaaaataattgtaaagaaaaacagggggaaaaagttgaagaaattttatattgcatatgatacagacgttgggataaaaaagaagaccaatcaggacagtctgttattaaaaggatgttctgaggaacatggagagacacttctgatcgcaatttgtgatggcatgggtggcatggaaaaaggggagcttgccagtgcaacggtcgtcagggctttttcagactggtttgaacaggtttacataaagaacgaaatgcatgttggagatgaaggaataagacaacagtggcagagtcttttggaggaaataaatggcagactgatcaggtatggaaaagaaaaccagattcagcttggaacaacaataagtgcggttttattaaacagtgatggacaatatatgctttgtcatgttggagacaccagaatttatacattatcggatacgttgcagcagctgaccgaggatcatacattcattgcgcgagaaataaaacgtgggaatatgacaatagaggaagctaaaaaggataatcgcagaaacgtgcttcttcagtgtatcggtgtgaatgaattttttgaaccacaatatgagaatggaaggctggcgcatggcacagcccttttgttatgctcagatggattccgtcatatgttatcagaagacgaaatttctgagtctctgaatccgcataaaaatcttgatgaagcgcagataaaagaaaaattgagagaaatgatcgaatggaataaacaacggatggaaacggataacatttctgcaatttatatcaaactcaaataaggcaaaagaggaaatgaaagttggcagagagaggaacaattattgagggaaaatacgaggttttaaagctgatcggaaaaggtggaatgtcaaaagtttacctggcgatggacaaaaacctgaataagcagtgggcaatcaaagaaatcgagagaaaagcttatgataagaaaaatgaagttgtagttgcaagtgcaatggcggaagcaaacatgatgaaaaaactggattatccgtcactgccaagaattgtagacattatcgaaaaagaaaatgtaatctatgttgtcatggattacattgagggagaaaccttaagcagtgtattgagtaaagaaggtgcacagccacaggaagttgtaattgagtgggcaaaggaactatgcagggtattggattatctgcatacgcagaatccgccaattatctaccgggatatgaaaccggcaaacattatgctgcagccgaatggaaatatcaagttaattgattttggtattgcgagggaatacaaagaacagaatttggcagatacagtaagtcttggaacaaaaggatatgctgcgccggagcagtttggaggaaaaggtcagacggatgccagaacagacgtatattgtcttggcgtgacgctataccatttactcacaggacagaatccgtgtgaacctccttatgagatatatccaatccgatattggaatccgcagttgtccagtggattagaagcaatcattcaaaaatgtacccagttaaacccggaagaccgttatcaatcatgtgcagaattgttatatgcgttggatcattatgatgagatggacgaggggtatcgaaagaaacagaaaaataagctgaaagttttttttattacagcaggttcagctgtattttttctgattgcagggtgtgtatgcacaggaatgagggttcatgtgaacaacagcgattatgataataacatcaagcaggcagaattatctgcgacagatgaggaaaaaatcgattattatgccaaagcaatagatattctgccgggcaattcggaagcgtattttggaataatcgaggcatttaaggatgacgcggtcttttcattggaagaagaggaattattcaaaaagaaaataaacagtaatctgactgttttgcagcagaatagcgattatggggatcttgcttttgagataggaaaattatactggtattactacgattatggaaaaacagaaaattcagacaatcagataaccagaatgaaaagtgcgattcagtggtttgaggcggcatgtacttatggcggtgaggacagcagttattatacgatggctgaaatgtaccgtgatataggacagtttaaccgcgatatcacactgaatgtgcaggaagcatctgataaaggaacctatcttccatattgggagaatataacaaaactcgtagcaaccgtatctgagagtcaggatgagaatgaaattgtaaatctggaagtatacaaactggcaatgaatgctgtggaaacttatgcaagaaaatttaaggcagatgacgtagcacaggaagatatgaaagcgttgctggaacaggtaaaagctggtacggagcaggttgatacgacaacagacaaaacagaagaaatgaaaaatgatattctaaagcgtttgcaggatgcagaggcagcagtggaaaatgcatatgcaaaagatacggaggtgaaagcatcatgaatgcaggtactttacaactcatatccatcattgcattttcattagcaggagttttaacactgatatccatttatcttttttttaaaatggatgtacggggaatcatagatgatcttagtggtaaatcggcagaacgtcagattatggcaatgcgagaggaaaataacagacagaaaaatccattgtctaaaagaagcgccaaatcatctgaaacaaggaaaagcagtctgatggaacgcacaacagtggaattgaaaaatgaggaaaaaacggaggttcttccgaaaaaagatgaggaaaagacagcattgctgcgggaagaagccactatgccgcttcagatggttgagaaggaaacaactgttttagaagaaactacaactgtattacaggaagatgaaacagttgtgctgactgaaaatgcaggaaacacagataaaaggtatgaactggtcttgaacgaaatcatcatacatacgcaggagataatttagaaaatggaaatgttttggagaacaaaaggaaaaagaattgcagcatggttaatgattgcgttaattatggcaacaacgataccatttggaagtatcagtgcatcagcagataacactgcaacaggtaaaagtggtacagtcacaatcacaggacaggtgatggttccgtatgatactaatgaaaacacgggtacgagtaaaggaaaagcatatgcaggtgctaaggtaattgtaaaatatcctaaagacagtgcgactactgtgactcataatgcaattacaggagccgatggaagttttaccattcccatagatgatttgacactaaaagaggatgataagtatacgattgaagttgagccagcagatgcggataaagatacatatgacagatattctgatgtgaaaacggtcactgcagatcaggtaagcactaaagcgattgagttaagtgaaattacgcttaaaaaaaaatctgcatcttattctgttactgcaaatgcaaatacttctgataattcagcaaaaaatgatgcaggagaagtaaaggtagaaaataatgtagtaacagcaacaccaaaggaaggttatgaaatcactgctgtaacagtaaaaaaagaaactgcagattggaaaccggatggagaaaccaacgataattggtggaacaagaatataaatgcgagcggtgcatttgtatatgaagaatttaaggataaaacattagatgcaaattatgcatttacagtcacattcgcaaagaaacagttcacaatcacctataaaatcagtcagaatggaaagctaattttaaatagtgatgcacaaaatgataaagttgaaatcacaaccgagagtggagaagacggtagccggaatgttccatatacagattctgagtacaaaataaaagcagctgttacagacaacaagtatcatcttacaagttttagagtggacaatgatgaaaagcttaatgaaaacgaaataaataacagcttaaaagagaaagaatatatattttcagaaggaataaaacaggcacatagtatagaagtgacagcagaaattgatacgtacacagtttctgttacaactgatgatggaggaattgttgaggttaatggttccagtgaaaaaaatattattgtagattctggagcagaagttgcaatcattgtaaaaccaaatgaaggtaaaacagtaaaaatattttcgatcaatggtacgccgatacaggaaaataatttaacagaggatgaagatggaacagcagtctataagattgaaaacgtaaatggtgaccagaatgtaactgctgaatttgaagatattcaaaatgaaaataaagattcgttggctcttgcaggtctgaatctgttagatagtggaaataatcaaataacagcggatgaggatggaaactattattcatcatcagccattttaaaatttgatggtaaaactaaaatcagtctttcgcaatggggagtgggcaaaacgcaactcaacttaacagaaacaactatcatttcatcagtgtataaaggtggaattattggcagaaaacaaataagtctcaatccgtctgtgaaaattgtgattgatacaacaaaacccaaaattgaactgagtgacgatgagaaaacaatttggaaaactgaagcagacacaacagtggatatcacaggtacagccgtggatgaaaatttgaaaaaggttgtctggtcagaaacagaacttacaccggatgatgtgttgaatggggcacaggaagcagcattaaatgaaaatggaaagtttgaaataagtggcattcaattagcaaaaaatcagaacattgataaaatctatatttatgccattgacaaagcaaaacagtgttcagaagccggagttattactgtatatcgggacagtgcagcccctgaaattaaggaagtgtctctgattcctgctgatacaataaaaaaatacgattttggtaattattacaatacaaacattagagtaagcgttactgcgaaagatgtgaatgtaaaagacggcaaagcggattatccggcagttggtgtgaaagaaattcgcgtatacagtgatgatgatacaaaagtgtataccggaactgtaagtacacaagtaagtggaacaagtgatgcaacgatagaagttacggttccattggaagaagctggtacatttgcaagcctgaaaaaggttcatatcaaagcagtggatgcattaggcaatgagagtaaggcatataaattaacagaaattaagaatcataatgatattttatcggatgatttaatgctggaaaaagatgcacctgtagtaaaggtgacaccacaggcagatggcaaatatgaaaatgcaaaagatggaaagacagagtattggtacaaagagatcccagcgattgcatgcggggttacagatcaaaaagatcagactaacggaagtggtcttgcggcgagaactttgaccgtaaacggaaatgaacttacttcgaagagaaagagctttgtggaaagaattacaagtagtgatcagattgtgcaggaggattctcttacactttcagcaaacgatttgaagaatgtgcgggaaggcgaaaatacagttgtcaccacctatacagacatcgcaggaaataaaacaattgacacaaaaacaatctgtcttgatacacataagccggatgttacaagatttaacattgaaaagaaagatgcattaaaaattttaaatatttttacctttggtaactatggaaatggtgtgatcaaagttactgtaacagcagatgatttacacagtgacgatggttcagaagtaccgtcagccggactgaacgaaattacattatatgtaggtgaagaagcttatcagacaaaggcagtcggaagcgataatacagcggtatttgaactcccggcagagactgttttaaatgaacagaaagtatatttagataaaaaaattagtgcaacagttacggataacgttggcaaccagtctgaaaagacacttgtgacgacagcaaattcgaatgtgaaaaacagcaatttaatgattgaaacagtgaaaccgaccattacatctgttttatcggcagaaggatatgttggaaaaaatggaatcatctataacaatagtgatactggagtcagcattaaagtagaagataaagattctggaatttataatgtgaaagtctccgttaataacaaggagttagtgaacgtttcttatccggatcagaaaacggttacggaaagctatgagatcaacacgaaggatgctgtcattaatgcagataccaacagctatgatatggtaattacagccattgacaatgctggaaatgaatattccaaaacacagcgtgtctacaaggatattacagctccggaaattttaagcattgatatggaagcagcaggaaataaagaagcagatggaagtgtttcttatacagagacggattatggttattattttgtggaaaatacaaaggtgactgtaactgctacggacggctccaaagaaggggattccggtgtaaaggaaatccactattatacggtagatgccaatggaacaaaaagcagtgagcagattgtacaggcagatgcagaaggaaaagtgacatttgtggttcaggcaggatttaaaggacagatttatgcctgcgcttacgatatgttaaataatcgcgaagaaagatatgtgacaccgagcagtctgatcattgaaacagccgagcagcatgcccgtgagaaacatattgattttaacaaggcggcagctgcaagcaaggatgcaaagggaaatgaactgtatgaaaaagatgtaatggtagatgttacagtgacagatacattttcggggatccgttctgtggaatggacagtggaatcgccttatgataaagaaaacaatcagtcaggaaatgtggagatcagtaatcagggtgcattttccagtggaaatgcggatggctggagtcagacaaagaaagacaaaaaccttgttacagaactgaaaaagtcattcactgtaaaaaataacagcaatgagataaaaatgcatatcaaaatgacagatcgtgcaggaaatacatcagaagacgaactgatattcagtattgataagacaaaaccggaaatcaaaattgcatttgataatgagacaccggatgctgaaaatacaaccatgttcaaagagaacagagttgctaccattacagttacagaacgtaactttgaggcggcagattttaaggcagatattaccaatacagatggtgtaattcctgagttgtcagcatggcagacaaccgaaaatacggaaaacccggatcagagtgtaagtactgcaaccattacatttgcagaagatggtgattatacgctttctgtcagtggaaaggataaggcagcaaatcaggcagagacagtaaaagcagatgattttaccatcgataaaacccgtccggtgattacggttacttatgacaacaataatgcagtcaatggcaattattatgcagcagcgcgtacagcaacgattcagattgaagaacataatttctctgaaaacagggtaaggataacaggaacagcaactgataacggagcaggaatctcattcccacagtctggcggatttaccggaaatggagatgttcataccgcgaccattacatgtggtacagatggtttatacaattttaatgtggaatacacggacatggcaggaaacatagctgaaacctatacaggggaagaatactatgtggatctcactgaaccggaaattgaaattgttggtgtcgaagattattcggcaaataatggagatgttattccgcagatcgtaatgtcagatacaaactttgataccaatggtgtgaacattgaactggttggtgcaaatcagggaagtgtggcaccggaaggctcttatacgaatcagggaaatggagagacatttacattccagaacttcccgaaagagcaaagctatgacgacatctatacgataaatgccacattgaccgatatggctggaaatgagagcaatgcaacagttacgttctccgtaaatcgctttggatcggtttacgtgttcgatcagaccttaaaggatattgaaggaacttatattcagaacgagattgatgtcaagttaaaagaagtgaacgtagacagtctggaacatgacaaaatcaaagtagtagtagatacaaatggaacaccgagaacattagaagaaggtatcgattatcaggtacaggaatccggtggaaacggacagtggtatcagtatgattacaccatcgacaagtctctttttgcaggggatggacgctacattgtgacactgtattcagaggatattgcaggaaatgtcaatgagaacattgatgaatccaaagaagcagagatttcattcggtgttgacaaaacagctcctgtcgttattccgattgatgttgagagcaatgcccagtatcctgtggatacgaaagcagcgaatgtgacagtcaacgacaacctggtattagatagtgttgagatttatattggtgataaaaaatgtgattatacagtggatggtgaaaactatcagttcaatatcccaaacaatacgaaaaaacaggatgtcacgattatggctgtggatgcagctggcaataaaacaaactatgtcttaaatggaattcttgtaacaaccaacacattcatccgttggtacaacaataagccattgtttgcaggttctattgcgggtgcagcagtggtgacaggcggtggcgtcggtgcatcgatcgcactgcgaagcggacgtatcaaaataagacgtaagagaaaataaaaaaaggactgagagatatggcaaagtatcgcatagtatcaaagggaaatatagttacgattaaaagtaagttatcatttggggagcagattaatgagcgggaaatcaatatttttgaacagcagattttccgcggctgtttcagaccgaggcaggaaggaaaaaagatgattatctacacagcaccagatgtggtacctcttatatcatatctgaaaaagggtgtggaggaagaaacgttttttctgcttgtggcgcagacaattgagatgactaaaaaaattgaaatgaatgggttgtatctgcataatctcatgttacagccggaaatggtgtttgtatgtgaaagaaccagggaagtgttctttgtatatcagccgatcaatagcagaattacgagtggaaatgtttatgcgtttcttgcagataccgtacagtatgcaggcagatatggcaaagagccagagcagtttctgaaggaattccaggcattcctcaatgatacaaagaattataaaatagaggacattgagagatatatccgcgaaaaatgtccacaggcattccggaaaatcgtaaaagcagagacgggaaaaagcggttacatcacaaatgaccgttcatcctatgaaagacattatcacagtgacagtaacgatgaaggtggaacgacattactgatggaggaggatgaaagcggtacaacccttttgacacagcaggaggatgacgagggagacacaactcttttgcagcaggaggaaagatatccaattttagagagaatcagcacaggggagagcgtgactgtcagaaaaaatatttttaatatcggtaaggaaaaagaaaatgattttacaataataaataataaggcggtcagccgtagacatgcggtaattgagcggataaatggaacttattatcttatggataaaggttcaacgaaccatacatatctgaatggagaaatgctggatgctgaaaattcttatgtgctttcagatcatgacagtattcagattgcagatgaagaatttacattttattttgattaggaagtgaaaaaatggacgagtactttgcagataaattgacagaaattcaagacactgaagacactgcctacttattggaaaataatgagatcttttatgacgttggctataaagtgatgcagaatcaggaaaatgccaacctgttaaggtgtcatagaatcaaatataatggaaaaataaaactaatttatttcacaagagaatatacatcactggaggattacattgcatcttcggatatggatacgatcttaaatgcgattcgcagtctgctcgaagctttaattcagattgaaaatcttggatttttaaatatggcatgtattgataatcgccttagccatatatatgtagagtctggcacgaataatgtgaagatcatttatttgcctgtaaatataacgggtgttcataaaaataaaaatgaatttgacaatgaaataaaggctcagctggtgcagaaaatagaacggataggaatgatggatcatccgaaaatgcgtcaggtgatagatgcgttggaggatggaacattaaaacttcatgacattagtacacgtatacaggcggaaaaacctgtaatgcatagaaatacaaaaaatacttctgcagatcccaatattgggcagaaaaagatagtggatatgccggacatgaatcagatatcaatacaatccatagatgggcagtttcactttgttgtttgtgaaaatgaattcctgataggaaaaagcagagaaagagttcagggtgtgataacaggaaataatgcggtcagcagagttcattgcaaaatcgtaaggcagaatggcagctattttgtagtggatatgggaagctccaatggtacttatgttaatggaaaaagaatacatccaaatgtgccagagcctatttcagacagaagtcagctgagaattgcaaatgcagaatttatagtacgaggataaaaaaatgagtaagccattaatcattattgcagatacagatgagttgtatctgcagaatctggaaagaaaatttttggaagaatttgatgaccagatagagttagaaattatatctgatccggtctattttgaacaacgttttgagacacctgtttcggtggaaatcctggctgtttcagaagcactatattcaacaggacttcaaaggcataacatttccaatctgtgtgtgttagcagaagaacaggagaatggaagcacggaggatttgtctgtaaacagagtgtataaatatctgggtatcagggaacttttcaatgaactgacttatcagagcagggatcggctgacggaatcacagacacaggaacataagacacagatcatttctttttattctgcaatcgggggaacaggaaagacagcattatctgtcggacttgcacggtgtctgtcagaaaaacataagagagttttctacgtaaatacagaatctgtgcaggatttttcttattatcttgaaaacaaaaccggtatgccgaatgaaggatatcgtgtcatgaaaaatgaacaggaacatatgtatcagaatgttcgttttacattaagaaaagaaggatttacatatctgcctccatttaaatcaacgctcgatgcaagaaatcttgattttacgatctatcgaaaattaatacagtcagcgaaagacagtggagattatgactttattattgtggatgtggaagcaggatacagcagatggagaatacagttactgcaggattctgataaagtgatgcttattacgttacaggatgatgtctcaacgaacaaaatgcactatatcacagagtgccttgatttcggagatcatgaaaaatacatggtcatttgtaacaaatacagtgaaacaagagacaaccaatatgttcagtcgggattacagtcagagttttccatcagggaatatattgatgaagtgagtaccccattgttaactgcaagacaacttgcacagttaaatgggatagaaaaaatgtcttatatgtttatttagatgaatgtttatttgaaaaacagaaaagagaaagaaaggatagaagataccaatgctaagagatttttcagatgcagcaaaacaaaagcttttaaattatgttgatgaagtgacggcaaatggaacatgggacaaggtaaaagaatggtttagtaacatagaaccgaatgttcagagttggcttggacgacttgatattcagaaatatgtaaatagtgtggaatgctattataagaaaatcctcgataaaaataattccaccaaaagacagattgaagagattttttcgaatgtgcaggcagtggataccagatatatcagtattacaggcagccagactgtatgtggaagtgacatcataaaattaatcaatgatcttgccaataccattgacccaaatggtgggaatatggacatgggaaagatgaagggtgttttggatgcagatgtcgagaacatcaggaatgcaaaggcaactgttgagaaaacgatcgaagaaaaaatgcttggaacagaagcggaaggctgtatgaacagcgaggatccggtaaacttaagtactggaaatttcatctatgaacacgaagatttaaaagtagcaggagagataccattatccttccaccgttattataattccaaagacagccgtacaggtgtgcttggcagatgctttttacataattatcagattgcacttgaaaaagaagcggatggaaccatcggtgtacgtcttgcggatggacagataaattaccatgataaaaaagggcaggaatatattgcgagaaatacggcgctggaatttctgaaagaaacggaacagggatatattctcgtgcatccggggcaggagaacatatcttttgatcaggaaggaaagatgcttcgaaaagaagacagaaatggaagaggtatttcttttttctattgtgaagatggaaagctgaaaaaagcagaaacggacaatggaagcagcctgacttactgttacaatcaaatggggcagcttaagaaagtaactgaccacacaggaagaagtgtgctgttacagtatgaggaggaaaaactaaaaaaagtaataactgcatctggggcagaatatgtctatcgttacggggaaaatggaagaatcacggaagtggaaaatgcccgtcatgtcacatctgttaagaatacctatgacagaagatttcgtattattcatcagcaatttccagatggtggaatgatggagtttgcttatgatgataaaaaccgacgtgtcacactcacggagcgcaatggaagtaagatcattcatgtgcatgatgaacgataccgtaacacagagactatttatgaggatgggacaaaagagcattatctctataatgaaaaaaaccagtgtatcagcatgacagacaggcttggcagaacgacgagaatggcgtatgataaccgtgggaacctcacacagaccgtggatgccctaaaacgcagggtcaattatacctatgatgcagattgtcatcttatcagtgtaagtattaacggaaaagaacgtctgaaaaaccattatgatgggaaaggtaatctgatcggcacggaaaatctgtacggaaacagaattaccgtgataaataatggggcaggaagaccggaaacaatcacttatgcagatggaagcgttttggagattggatatgatgaaagcggaaacatcgtacagttaaaggatgtaactggaaatgtgacaacttatggctatgatgccttaaatcgtgtgattgagacagtagatgcaaataggaacgtgacacgttatacctatgatgcagcagaccgtgtcacaacagtaaccgatgctatgggtaatcagagagcatacacttataatgcaggtggaaaaatcacggcaatccgggattttgatggtaatacggcagagtttatctataatccacttggaaaagtggaaacatacacagacaaagagggacagcaggtacatttcacttatgacaaaatgtggaacatctgttcggtcacagcgccggatcatggaaagcaggaatatttttatgacagtgacaatcatcttgtaaaacagatactcccgatgggaggagtagtgaaatatgcctacgatgcggctggaaaccgcacagaaatgacggatccggaaggaaatacaacccgttacttttatgatgccgtaaaccgcctgacagaagtactggaaccggatggagccaggactgtgtatgaatatgacagagagggaaatcttgtcagagagacgaatacatccggacagacgaccagttatacttatgatgatttaggaagaagaacaagtgttacagatgcggctggtgcaacgacaagtgtactctacaatgaacttggaaaagcagagcgtatctgctatccgaatggaagcagtactgtttatgaatacgaaaaaggtggaagattaaagagtgttcgttacccggatggtgcaggagaacactatggatatgatgccaggggaaaactcacagagcgtaccactacggcgggagaatgttacaaatatagttatgactgtcttgcccgtatcacatccattgaaaatccggcaggaggtgtggcatattttacctatgatgcacttggacgtgtaacgaaagcagaagatgaaaagggaaatgttacctgttatgaatacactccaaatggcaatcttgcaaaagtgacagatgcgttgggaaatgaaacattttatcagtatgatgcaatgggacagctggtacagacaagctgtacaggaaccaatggggaagaaccacagaatacagtctatacctgggataaagaaggtcatgtgaccaccgtgacagaccctttaggggatatagaacgctatacttatgacccggcaggaaaaatgagggcaaaagtagacaaagatggttatgagactaccttccattatggcacaaatggtcaggtggaggaaatctgttatgcggatggaagaaaagtatccttaacctataatgccataaggcagcttgaggaagtaaaagactggctcggcacgacaaaaatcgctatggatgaggcaggacgtattgcctctgtcacagatccatatggaaaaaccgtgggatatgaatggggaagcatgggtgagagaacggcagttttttatccagatggaaaaaagaccgtatatgaatacaatgaagccatgcagatatcggccatgaaaatcttttctggggaaatgcgggagaatacaattcgttacagttatgatgaattcggaagactgattggaaagcagctgccgggtggaaattatacagattaccgatacaatgcggcaggaaaacttgaagaaatcttacataaaggagcagattttacagagcgctgccactattcctatgatgtcatgggaaataaggtcatggcagaaaaggaaagaccgggattgccggaggacagtggaagtttttcttattgttatgatgcattaaaccgtttgaccagcgtagcacagaatggacagacattaagaacatacagctatgatgcattcggaaaccgaagcagtaaaactgaatatcagacagcaggagggctggtgacaacttaccgttataacgccagaaatcagctgttgcaggaaacaaatgcaaacggaacgaaagattatgcgtatgaccacagaggaaatctgttatccgtaacaagcggtgaagaggttttgagagcatatgggttcgatgcggctaaccagatgaacagctctatgggaatgacagatggacaaatcaaaaaggcagtatatcagtatcacggattaggacatagaatggagcaaagcgttgcagcaggggatgcagccccggaacagaccattcgctatacacttgatcttacccgccagtatcataatcttttacagaaaacagaaaataatgaggagcagacctacttctgggatggtaatgtcacgggaatggaagaagaaggaagggagcacttttattttcaggatgatctgggaagtccgatgcggcttgcagatgaagcaggaagaagtgaggaaacctatggatttgatgaatttggtaatgatatccgaacggcaaaagatatcttcaaagattccttacagaactttggttttacggggtatcagatggatagtgcaggagggctgtattttgcacaggcaagaagatatgatgccggagttggaagatttgtcagtgaagatttcataaaaggacatattgcagtaccgtacacaatgaatcattacaattactgctggaacagaccaatggatctggtggatttgaatggtatgtggcctagcctgaaagatatcggggagggaattaaaagtgcagcaaatagtgttggagagtttgtttctgaccataaagacacaattgcaactgtagccacagtggctgttgcagctacagttattgttggatgtgttattacagcaccagtagcaggagcagtaatagcaggtgccgcagtaggaggaacaataggtggaataagtgagattacatctcaaattacatcagacggtaaagtgacaagtataaaaaaagtaataatatcaacggcactgggagcagcttccggggcacttacaggtggaacagcttctgcagccacatcaattgtaggtaatgctgcattatctgcgggaggttctgtggccaaggatgttgtaagtattggtaatggagcaaatatttcaggaaaagatatggtaataaatgctgccataaatggcggaataggggctttaagtggtaaaataggtggtgcaggcgctcaatataacaagtttaagtcaactactgttaatacaattttatttaatggagaaaagatattaggggcatcaactgaaactatttggagggaatatgggaaatattatacagactctattgcaaaagctatgctaaaaggatttggatatggttcaataccatccactgcggtgacaatttggcagattatgcatagtggggaggagaaagaaacgtgcaaggaatagaaaaaggtatatttgtttctatatggatatggattataataaaaatttcagaaaaagtttccggtaatacaaagtatcaaattcaaaatcgttttttatactggtttatatggatatggcattcatatggcaaaataagtattttaggattgttatgtggaataggtgtacagattaccaatattataattgttgtattgtatttgttttttgatataagtagggaacttttaggagcatgttgggtgacaagtcttatagtagttctatttgtgagtggaggtattggaattatagagactggaaaagagtgtgagggatggcttggaaaaatcggaatgtatttaattagtatagttgtattttttacagcaggttattttttgtatcccatgttacagtatatatttaatttctaaaaaggaggtcttggttcaaaatgacatttttgcttatattaattattttattttatattgtgtttggcattgtagatgtacggtttggttttctgtgtaagaaagagcaacgtaaaaataaaacaattgcgcagatatatgtgggcacgaaaaagattgtgtggatttttggaactatttttttcttaattggaattttggaagttctacttttactatttagtttcaatatagtaccattatatgtatttttggttatgtgcattgctgtacaatggggatttgcaacatttttatggaattatttttgttattcagcagtgtttatgaatgaggaaaaaatttatttttatcataagagaaaaaagcaggaaatttctttagaaaatattgcagagattaaggcggctttaggaaatgtcgcatatactttttttgatgaaaataataatatgttatttgaagtacaaatgaaaaaagaaaacgcatatcagttggtggagtatatcaagcaaagatatgctgtgtaaggatgaaactataatatcaagcagaggacttgcgccttttaaatttgaatacaaaggatatcatggggatagctggaaatttgaacgaaatatgaaaggtgcagttcagacaatctctatatatccatatcgttttgaccagagcatgataacgtttgagttatatacaaatgtaaaaaattcggagtatgcaagtaaaattggaaccaatgtggtatcagccagtatgctggatggaattgtatccaatggtcagatacgtggttactggcagtatgggaatgaacaggaactgattcaggtgttgggcgagatgaaagacgttctcataaaaaaggggatgaaaatattagttgagttaagtaagggactggaggaaccggatactgccgaaatgtaccgggaagtttattttcatcatgatgaattatgcgaaaaatttatggaaaagacaggcattgtggtaacaggatttgatgaggagaatatcgaccggtggtttgaagtaatagaagaacgtacagcaatattaaagcagggtgattacgaggatgcaaaagaggaactgatggagattgccgcatttctcggaaatcagcttgtaaaatatcttggtggacgctggtttcattatttgtcagaaaatcatgagagctgtggggttgaagggtgtaaaacgttaaatccgggactaaattgcctgagtgtggtagttggcggatacaccgaaaatgggatgaactgggttaaagaaagtattgtggatatgtgcgagaatcgtaggaaatagttgagaaagtatttaatgagtgaatcaaaggtatgttttaggtggaaacatggacagaaaatttaactgatataaaggatagaagataccaatgctaagagatttttcagatgcagcaaaacaaaagcttttaaattatgttgatgaagtgacggcaaatggaacaatggaagcaggttgaaatcctgcagttatggattcaattgaccaatagatatgaatgatatggtatcggcagtagactgcgcaaaaaaagaatgttgagaaatcagcattctttttttgcattttttcgcagcaggcaatcattttagcaaaattacatcagattatatggtgtaaatttcgggaaaataatacaattaaaaataattgtaaaaaataaagaaataaaattgacgataaaaaaacagcatttccactaataccgggaatgtttttgtagtttatcggagcaggggttaatttttatacgaattatttcatgtggagataaaggagagggaatggaagaaaaagttgtagttgaatttatcaatgatatgaaacagacacatgtggatctggaaattccattggaaataacagcaaatgatcttgtgcttgcactgaatgaggcatatggattagggatggatacggataatattttcagttgttatcttgttgctgagaatccgatcgcttttttaagaggaaataaaacattaaaagaatttggcatcagaaatggttcttatattatctaccggagggcgtaaatatggattatcagtataaaataatcgtcagtaacagaacagtatataaggaatttgaaattgcagcaggggtagagaatgtgagacttggaacaacctcatcctgtgaatttcgattgaatccggaaacttttttttcagagatcgagattgagttttcggtacatagcaataaatggaatatggactgtgcggatcaattgtattttagcagaggtgatatgcggaaaatatattctatggagatcaaccatggagatatgatatcagtctgttattcgaatacagggaacgaagcgtttgaaatgcgctttatgattgactttgaggcgaaagtaccaaactacaactggtacattgaacttccagagcggatagagatatcttcggaaccgggagcagcagttgttttaaggagccagtttgaaaaaaatatccagctcgtaatacaaaaaagaggaaaaagttattttctgcagaaagtgcagtcagctttcggcgtgttgagaaatggacaacagatagagcaaagtgtggaacttcatgattgtgatttcttttcggtggatgagtaccaattttattttaaggaaggaaaaatttattttgatcagactggattgcggataaacaagataccggtgcatgaaatcagacattgtgtcaacgaactggaatatccgttatttaaccggaatacgagaatcataaaacagcttccagatgaaaagatagaaattttagatgctcctgagattcctaagaaaccggaaaataatattgttatgaacctgatgccctctattacaatgattgggcttgttgttgtgttccgtggaattatgaacacttctggttcatccggctcgtatgtgattttgagtgtatgctccatggcacttggggtggtgactaccatattagggtttctgtcgggaaataaaaaatataaaaaggactgcgaggaacgtattacaaaatacaatagctatattgacaagaagaaacacgaaatcgaaataaaacgtgaggaagaagaggaaagtttaagagatacatactgtgatgtggcgagtgatgttgacacagcaatgaattttgatcgccgattatttgaaagaacaagagaggatgcagatttcctgtgtgtatatcttggaaagggaagcgtggaatccgagcggcagattgattataggaagcaggaacggatggaagtaggcgatgaacttacagatctgcctgaaaaaatctgtgatatgtatgcaaagattgatcatgcccctgtttatgcagatttgaaaaatgcaaatgcagttggagttgttggagaaaaaaaggctttgtatgcaatgttcaaaaatattgcgattgatatctcagtcagacattattacggtgatgtcagactttttctgctggtggatgatgaaaagcaatatgagtgggtccgtatgcttccgcatcttggaaatgagaagggaacacgtaatatcgtatgcaataatgagagcaaaaataatctttttgaaaatttgttccgcgaattaaattatagggagcagacaaaaaatattccctattactgtgtcattcttgttgaaaatgaatttggtatcaaaaatcatccaatttcaagatacatcgagagggcagcagaacttggaatggtttttgtatttttcgagacaagtgcagaaaaactgccattgcattgcaaccaaatagttacactgacttccgggcatgagggaaatatctgtctttctgaaaatggcaataaggtgcaggaatttgagtatcaggcaatatcagacatgcaggcaggagcagtggtacaaatgctggcacctgtttattgtgaagaaatcggacttgaaaattctctcagaaaaaatattacgttatttgaattacttcatatatttgcagcagaagatctgaaccttggaaaaagatggggtgagtcacagatttacaagacaatggcagtacctcttggagtaaatgcaaaagatgaagtagttactttaaacctgcatgagaagtttcacggaccacatggactggtagcgggaacaacgggatcgggcaagagtgagatactgcaaagttacatattatcggctgcaacgatatttcatccttatgaaattggatttgtaattatcgatttcaagggcggaggaatggtaaaccagtttcggaatctgccacatctgatcggtgcaatcaccaatattgacggaaatgaggtacagagatcattaaagtcaataaaggcagaattgatgaagcgtcagaatcttttcgcgcaggctggtgtgaaccatattgataaatatattgaactttataaagagaaaaaagtgcagacagcattaccacatctggtaattattgtagatgaatttgcagagctgaaggcagaacagccagattttatgaaagagctgatatctgcagctcgtattggacgaagtcttggagtacatctgattcttgcaacacagaaaccaagcggtgtggtagatgggcagatctggtcaaattcaaaatttaaactttgtctgaaagtacagtctaaagaggacagtaatgaagttttaaaaacaccgcttgcagcggagattaaagaacccggacgggcatatctgcaggttggtaacaatgagatatttgaattgtttcagtcggcattcagcggggcacctgcaacgcttgatgagagtgagggaaataaagaatttagtgtttccgaactgaattttgctggaataaaaaaagtggtttaccagaaaaagaaaataaaaaagaaggattcccatacgaagaaccagctggaggcaattgtagattatatagcagaatattgcgaagaaaaaggaatcagaagactttcgaatatttgcatgccgccattgccggaattattaacctatgagaatggggagaggctggattcagaagaaatttatgcatatataggtcttctggatgatccggacagacaaagtcaggaaaaactgaaaattaacattacggcacagaactatatactgatcggttctgcacagtgcggaaagacaaatgtattacagacgattatccgaagtcttgcagaaaactatacaccggaggaggtaaatctttacattatcgattttggctccatgattttgcgcaattttgcagagcttcatcattgtggtggtgtcgtgtgcgtatcagatgatgaaaaattaaaaaatctgtttaaattgctgcaaacagagatggtaaaacgaaaagaaatactggcacagtctggggtaagttcttttgttgcctataaagaagccgggtaccgtgacctgccacagattgttgtagtgattgataatctgacggcattgaaagaaatgtatctgcaggatcaggattatctgctgccattgtgcagagatggaatagcagttggtatttcatttgttgtggcaaatgttcagacttccggtattggctatcgctatctgaacaattttgaaggacggatcgcattattctgcaatgagacatcagagtatggaatgatgttcgagggatgcaggatgaaacttccgaacattccgggaagatgtctgatccagttgaacaaacatacctatgaaagccagatgtatttgtcatttgaaggcgaaaaagaatatgagcgtgtacagaaaatacaggagtttgttcagaaacagaatgaaaagtatgcgggaatgaaggccatgataataccggaaattccaaaagaactgacactatcctacatccagaaaacttacccggattatttagaggaaggaaaagtaatgctgggacttgattataatacggtttctccaatgatgttagaaattgcgcagggaggaatgtttacgatttcaggtaaaaaggaaaaaggaaaagatatctttgtaaaatacctgcttgaagcaatgctgcttccggcatttggaggtacagacctgtacattctggatgatatgacacggagatgggctgattatgaatttcatccggacacagctgtatatgacaatacaacaggatctatccggaccatttttgatgaggtcgatcagcgggtgcagagcagatatgaagattttgcacagagacaggaagctgcattggatgatgagaactggatcgtagttgtcattgaaagctcggacgcaattgcagagataagcgcagacaaaaaaataattggaactataaaaggaatgctcggcaaataccgcatgatgaaagtgctcatacttatgaccaatgtggaaaatgcggcaattccattcagtgcaccagatttaatgaaaattgtaaaagataaccggagatatattatttttgatgatatatccaatattaaactgtgtgatctgtcagtgagcattgcaaaaaaatatgcaaaaccaatagaattttgcgatgcattctatgtgaatgagaatgagctgacaaaaattaaaacagtaaaattatcatgatggaattctgtatatgcagatttaccatataataaaaattttaaggaggaacaaaaagatggcagtaaacaaagtggattatgaggtgcttacaagtggagtaagtgtgtactcaaatcaggcaggagcacttgacgatgtgatcaattccctggttcagatgaatggtcagttacaggatggatggacaaaccagacagcagatgcattcattgaacgttttgagagtgagtacaaaccagcattggaaaatgcaagggatgcgatccagagtatttctgatttcattcagaattacatgcagaacagacaggatgatgatgcacagggtgctgcggctgtaagaggctaatcttttatccatgcggattcttgaaaaacaggaacccgcatggataatcctgaaaaatgagaaaaataattgaacataaacatgaaagtgtttaagataaaaagtgatatacagtggaggagaaggcatgacgaagtcgcagtgttatgcggagattgcacagaaacaaagggagattgcagattacaatgcaaaaatccaaaagcttaacagtgaaatatcggaattaaatcaggtgaaaagcaggattagttcgcttcagggatcattttcagaatgtaaaaattcaggaacatccagattgggaaatactggggatattcagaaaattaacagcaaatttacttctaaattctatgaaggaatgaatgatttatataatggcgcatcttttcagaatgttttcggtgggcttgataaggcaattgagcgtgttatgttggaaattacaaagaaacaaaatgaaatagcccgatataatcaggcaatacaggattgcaacaacagaattagtcagcttcattcagaaatagccagcattgagagagcagaacaggaagcaagagaagcagcggcgagagaggcagcagcccgtgaggcagcgagaacggcagccgtgaatacgtcaaagaagaaataagtaaagcaattcaaaggaaggaagcttagcatggcaggaacggcacttaaaatagatgatgattatgttttagatatgggaacaactctttcagataatgagacggagttacagtcaggtgtagacaagtatttggaaattatgaaaaaaatcagggaagatgctattaaggaaggggaaaccgcacaggcattggatacatttattacttatgctggggaattaaaaaatgtgatcacagaacatggtgtgaatgtaaataaaacgtgtcaaaaatttaaagctgaaatagatgaaaatgatcagtatttattctaggaggggcagatgatgacaaatgttatagatacagagaaattaggcagttatattgtggagttaaaaaatctgcatacagagtgggcagcaaagaacgttgttatgccggatgtcggagaatgtggaggcagtacgattattcagattgaggagatgggaaatcagtatcagaaaatgcaggaggcatttgttttattgttggaaaatacgatttcctacatggaacagagaaaaagctcggttgagacgaaagaaaagacacattcagaaacattttcttcataggaagaaaaagaaagcatggggataagaaaatgttcagggatttttcacaggaagcaaaagaaaagctgataagttatgtgaatgatacatcttccgatggtatctggcagattataaagaatagtattgattacatggatgtaaaaattaaaaactggctgcatacgttagacagttatgcttatttatctcaaatggatggttattaccagactgttctaaataagcatgatacaaccattgaacagatcgaacagatttttacagccgtagaacatgtagatacagcctatctcaagcacggagcagagatgaatacatgtgcagaaaaaatcattaagttaatgaatactctggcacagacgatagatcctgccggaggtaaccttgatatggcttcacaaaaaggtgttctcgatgccgcagttgcagatctgaaagatgctcaggcaacggtagaaaaagaaattcaggaagaattgctgggaacagatgctgctggtacaaattattgtggtgatcctgtgaatatgacaaccgggaattttgtgtatgatagggaagatctggttgtaagaggagaaataaatctttcatttcataggtattacaattcaaaagatgatacaacaggaacaattggaaaaagttttagacataactatgaaatttctttagaaaagaaaacggaaataagcgcttgcattcatatgtatgatggacaatgcttatattttgaaaaagaaaatgatggaagttataagggaacaggaactgctttagaaatactgtttgagaatgaagaagggtatagattgtgtcgtgcaggactagatagcatgcagtttgataaaatgggaaaattggtgcgtgcggaagatataaacggcagaggaataacattctcatataatgaaagtggtttattggaaacagcttgtgcagataatggaaatatcttttcttattattataatgaaaaaaatcttttggtaagagttgaagatcagtcaggaagaaagatattacttacatataaagaaaatttgttggaaacagtcacacttccagatggtggagtctatcagtatcaatatggtgttgacggaagaatctcacatgttgagaatgccggtggagttactaccatatgtaacgattatgataataaacatcgtattacgcgtcagaaatttccagatggtggagtgatggaatttttgtatgatgatgtaaaaaagagagttatttgtacggagcgtaatggccaaaaaataatatatgtgcatgataatttatatcgtcatacggaaactctctatgaggatggaacaagggaagaatatatttataatgataaaaatcaatgtgtctgcgtaatggatcgtaataaaaatagaagacgtatggcatatgataacagaggaaatctgacgcaggtaacagatgaagcaaaacgcagaatcaatatgacatatgatgcaaataaccatttattaaatgtgagtataaatggtaaagcaagattaaagcattattatgatgcacatggaaatttgatctgtacagaaaatgcggatggagctattgtcaaaattgagaatgataaggcaggaagaccaactacagtagtgcagccggatggcagtgaagttgcttttacatatgatgatcggggaaacattatttgtataaaaaaagcaaccggcggtgtagaaaaatatcagtatgataatttgaaccgtgtcattaagacagtggatggaaatggaaatgagacttcatatcagtatgatgtggcagatagaattgtaagtgtaaaaaatgctaatggagatacacgtacataccagtataataaaaatggaaatttaacagaaatttgtgattatgatggatatactttaaaagcaaaatataatggcataggacagctggaatatttaatagataaagaaggcgcagcaactaaatatttatatgataaaatgtggaatatttccggtattataatgccggataaggctgtatacaattatatttataataaggaaaaccagctgaaggaagaagttttaccttatgggagcacgataaagtataactatgacgctctcggaaactgtattgcagttacggatgcggaaggaaacgttacatcgtatacctatgattgtgcaaatcggataatagaagttttagattcagatggagaaaggacatcctttacttacgataaggatggaaatttgattacaattgtaaatgcattaggtgacattacatcttatacatatgatgaaatgggcagacggaacagtgtaacagatgtagaaggaaatacaacgagtgtctattacaataaaatggatcaggtacagaggatttgttatccgaatggcagcagtacagaatatttgtatgaaaaaggtggacggttacataagattcaatatccagatggggcagtcgaaatttatacatatgacaatgaagataatctgatccagcggacaaatgcattaggtgaatgtgttcagatgaagtatgacagacttaatcgcttgacagatttaataaatccagcaggtggagtacggcattattcatatgatgcagttggcaatgtggtagagatgattgatgaaaatggaaatcgaacatcttacgaatactctccaaatggcgatttgacgtgtgtgacagatgctttaaacaacaagacatattacacatatgataaggttggaaatcttttacagataaaacgtaccggggaacaaggggagagcgactctgttactgattataaatgggatctgcaaggaaatgtgatccagattaaagatccattgggtgcggttgaatgtttttcttacgatagaaatggaagaatggcagccaaaacagatcgtgatggttgtgttacaaactacaaatataatccaactggacagataagtgagatagtgtatgcagatggccagaaagtaaaactttcttataatgcacttcgacaattagaagaaatgaaagattggataggaagtacgagaatctgtctggataaaatgggaagaccgctttctgttacagatgcaaatggacaaaaagtttcttatgagtggaacaatatgggagagaaaacgaaaatagtttacccggatggaaacgaggtgcattatacctacaatatagccaatcagcttatacaactagaaaatgaaactggtgtgattacatatgactatgatgaaatggggcgttttaaagaaaaacatcttcctaatgatgtagttacatcgtattcgtataataatattggaagaatagcaaaaatcacgcatcatgatcaggaaaaaataatcgattcttatgactatacctatgacaatgcgggaaataaaataacagttgatcagaagcggagtggcacaggaatacagaatgtaagctatacctatggttatgatgcggtaaatcggctgatacatgtcagcagagaaaaagagaggcttagagaatatacatatgacgcctttgggaatcgcatagagaaaaaggattttgaaaatgaatcaataatacgttattcttacaatgcgaataatcagcttatcagtgagacgggcaatttacttgaaaagacttatcaatatgatcagcgaggtaacattcgaaaaatctgtgaagatggtaaagtattaaaagaatttacatttgactgtacaaataggttaaaaaaggttcaaaaatttgaaaatggaattactgatatagcagaatatgcatataacggtctcggacagcgagtcagacaacaaatatctggaaaaaaagatatacactacacgctggatctgacaagaaaatatcataatcttttacaaagcaatgaacaacattctggaagaagacagcagtttttctgggatggaaaagcagctggaatgcttgaaaatggaaaaagcacatattatttgcaggatgatcatggaagcacgatgtgtatggtagatatgcaaagagagatagatgctttgtatgcatatgatgaatttggtatgcctgtgtataagaatgagaagtatacgcagccatttggttacaccggatatcagatggatgaaatcagtgagttgtattttgcgcaggcaagacgttatgattccagaacagggcggtttgtaagtgaggatctgatcaaaggattcccggaaatgccgtttacaataaatccatatatttattgttgggatagaccggaagattttgaagataatgatggggaatggccaacagttgtaattggggcacttgtaggcggtattgtaagtggcgttattgaaatcggaagtgaagcattaggcggagaagggattgatccaaagaaaattggacttgaatttgcaaaaggagcagtgaaaggggcaattgcaggaacaggagccggacttttggttactgcggctagtaatggattgattgatagcaccgctaatgcaattgaacagaaatttatagaaggaaaacagaatattgatgttggagaagtggtagaaacaggcgtgtggagtgcaggtacaacattggcgtttggaggtctggataaagcggttgataaggttaagagtggtattggctgggataaagcggtaaagcagttgaaagatgagaagggaatttctgcgtggatggagaaacgacgtataagcactgagaagataaaactgcgggaaaagcgatcattaagtgatattattcatggaagaaatcagccacataaaaaggagtatacgaaaatattgaatgatttaaatgtgcgggttgaggtgctgaaatcaaaaaccgatttggatgacataagggggaatgtatgccggaacgccagaaagagagctactgaacatcttggaagaaagaaagcattaaaatacatgattatcaattattccggacaaaaattagtaggtggcgtgaaggacaagataaagaattctataaggaataacctgtatcttagtaatctgaaggatgccgtggatattgatggtcatgtaaatcaatttatatgcgcatttacataagaaattggaggagaaaaacatgttagcattttgggtaacattaatcaaagttatagctccgtgggtggcagcagcggtagtgattcattatctgaatgtgtataatgagaaaaaatatccggagttttataattcggataacgaaaataatcccaaaagtttatttgaggattttgaaatagggtatccgtttgcgttggcttttataatgtatgtaggtttgttttttatgggtggagtgtttatttatgcatgtattactgatcaaatagatgtatttacttgcattttatatgggttaattattggtttatgtataagtggtgtcttaggcacgcacgtctggaaaatctgggtaaaaggcgaaaaaatcatttatcgcagttacacaggcataaaacattattatacatttgcagacattaccagagtgtcagaacgattagacggcggatatgaattttattccgggaagaaaaagcttttcaggattgataataatctgccagagggttcaacattagcaataaaattgcaagttaaacaagtaccatgcgacaaagcgggaatgactattgataaatttacattaaaaacaaggggcgtttataaagctgtttccgcaatgtcagtaggctttttctgctggatggtatgggtgatgatcgagcagaatgagacaaatataatattcttccgtccgatgcttgcattggcggtaatttccttaattattttcatagaccttataactgacagattttcagtaaatggaacaagagtgacacgcagacgcggactgatcgtgaaaaagttcgacatcagtgaaattgagagtacgagattgaaaaaaggattgttcggtgaaaaaattgagttctatgtgaaaggaaagtgtatcgcaaaagtttcgacgaacaaccagccatatgatttattggacaagcgcattagaaaggaacatattttgcgtaaaagataaaacatataatcagaattgttgattaattattccaaaacatacaaatggtggtaataaaacatacaaatagcttgaaaaaacagcacaaatagatgtaaaataaacaaaagagtaaagacaaagtcaggagaaaaggatgagggagaatataattcagaaaagaaaaatttctgctgcaatctgtgaggaatggcttgaacgggacaaggtattgagtggtcggcagaaggatgccattcgtcagtacgttaggatgcatacggacaagccggaggaactatatcaaatttaccatgcgatgattcgtggagaaaattataaggcagagacattggaagtattaatggaggaaggacagccggttataaaaattgccgggaatgaaatcagggcggcattcgagcaattgaatgattttgtacaaaagctgatattgcttacagaaagaacattgccgctgggaagtgttgtggaggttgatatacgggaattaaaactggaaacagaaaagccggtatcaagtattaaagcagtgattgtggatcggtttatgaaaaaggaaacggaaaagcaatatgtgccgtattgtgggattatttatccgtttggggattcaaaaaagcagctgtttttcacggaacaggcaatccacacagtaatacactatggttatacagacaggcaggaagatgcgtatgttgcattgataaagcgggagattataaaaaaaggatatagttcctacagttttgcggaggcagaagatgacaaaatcagaatgttacagtcagatatcaatctgtaatgcagggattgaggaagatcagaaaaagatcagggaatgggaagaaaaaattgatctttatgagaatacgaacaggcgcctggaacggggacaggaaaatatggctgatttttgttcttgtcatagcaggaaaatccgtcagacaagagattattttccgcaggtaaagtatgtagaaggttatgttcaggacatgacggaatatcttcagggtgcagagtataacagtgtgaatggaaaatttgatggcgcaatagcaacaatcaacagaaaaaaacaggaagccatatcggaaatagagaagctgaatgaagatatcaggaacaaacagaaccgcatagtgcagatgcaggatgagatacgggagattgagcggagggaagcagaagaaaggcggagagaagaagaacggcgcagggaagaacaaagagccagaaacagcaggatggcatcaggattatagagaggcagggaacagaaacatgcagagtttaggatatgatcttattgtagatgatgacggaattatacaggaagccgggaaaatcgtagaaaaaacagaagatttcgagcagaaactgggggagctgtcagatattttatcaaatgtgctggatgatgcaattatgcagggaaacacagcggaaaatctcatgctgtttgcagatgaagtgcaggggttacggtcagaagcacaggagatagcggagcaggtcaggagagcagtggaaaattatgttacatctatggatgaagcagacagttatgtttactaaaagaggagggagcaatggcgggaataaagattgatccggaaatgctggatatctatatggaatcgttgaacaagcttatggcaggcagcgaaacggacggaggcaatgccagactggaagtatcaggtgcaggaaagacagaggatggactggtacgatataatgaggaagtcaacaagctgggagatgatctgagggaattgtatggaaatgtgggggaaatacttggcaggatcagggatggaacactggaggcagatatttacggagcagagagcataaaagcagaagccgtgacggagaaatggagtgaactgggatggtgagggatttttcgcagaaaacagtacaggaactgtatgagaccatccgtgtgaacgtggatgaagaagagcagtggaaagtatttgactttgtagaagatttttttatggaagaactggaaatcggagattatatcaatgatattaacagttaccatttacatatgtttgacaaacatgatgtgacaacaaagaagtttgatgctatagtagaaaaagcagggaaagtggatgcaaactacgcagcacagatagaaggatactgcagcctgcttggagaatacgggaaaaaatttgaggctgtatgtgccatgctgcagccggagaaactgagattatccccggataaataccgcgaaaaactggaggggatcaataccggctatcagaatgccaaggatacccacgagcaggaacagtcggattatgaggcagaactgtatgagatagagactgtctggtataaaaaaatgctggacaaagcggaagattatctgatacggagtgccgaatgtgttgtcctgggtaattttacagatgaagtgacagtacttggagtgggtgtgcagattgtccttggaatttttgatctggatctgccatgtgatatccgggatatcattgcggatgtaaggaatcttgccaaagcagatgatataaaatgggatatgatcgccatgcttgcgcttgatcttatcggggtaataccggtgatcggtgcattaaaatattcggacgaaataggaacactgttcaaaaatgcagataaagtcagtgtggtggcgagaagtacagatggcactggtgtgctggcaaagcatgcagatgaggcaggagcatggctgcatggggtaaaagtgttcaggtattcggatgagacagccgaagcagtgacatcaggagaaaagctgttaacggaaagcgggacaatatacgaatcatttgccgatatgatgtcaccggaggatgcaaaaagatatttggattttctggagaatggaagcagagaaggattgacaagtgccgagctggcagatgcattgctagtatcccagaaagttggatatgaggatgtatgggatttaaggaatgtaggagatgcgcttgagagtggtataaactcttatgctgattttagtaaagcaataagcgatattggtatgagaagtgatttgactgatgcccagaagataagtgaattacaaaaattgtttgaaagttcaaattataaagctgatataaatgtgccaagtgatattcaatatgtaaaaggttttgatgcgaagggaaatgtaatatatgattggccacctaaattaggctttgatgaaagtacaatcaaatctatttccagaacagatagtttacctgatacgtgggatagatatggatatatgggaggctctaattttgcagatgttcctccaacgggtaaatacacatatagtgaaagagcaattccttatgtagagaatgaagcagcttatcatacgggagcttttaataatgcaacgtattttgataaaattgatgcaataaaaaatggagatatagatggcttgaatacaattttatccagggaaggaatagcgaatgttgattcatcatattttaaaaatttgcaaaatacatataatgattttattgaggatacagcaaatgctgtaggaagtaatattgatgccacttatgggttaaaaggaacagcagcttcgtggggagatatgtctggaggagcagggcaatatgttactccacttaacggaagtactatgaaacgattaggaattataaattgaggtaatgcagatgaataaaaaagaatttatgaaaattaaagaagaattgcaatgtaaattgggaaagtggaagttggagatcggcgatgaaattcttgctgattttacaataggatgtttttatgatacatgtgagagaaaatggaaagtgtatgttaataatgagcgaggaagacatagaattagattgatgactgaaaacgaagaggaggcttttgacgaattgctatcaattgtaaactttgagattgaaaataataaatatatttaattgagacctccctttgtatgcggtaattcctgttaccattgttgttgacaaactttagtatataggtaaatccacgaacctacaatgcggaggtcattacatattgtctagaagcagcatttattttttggaatactggtattataatcacgtctttgacggttgataaaagaaaaaatcgatgtatcctttatgcttattggattacagcgattttttcttttgttatatagcataataatataaaatgaaattatgaattaaaagaactatagatttacatagatgttagttataaaatggtaatggaatgagcagaatgtttattaaaatttatggggaatgataaatggctacaatcacattatataaggacaagttaaacagtgtaagcagtttaatcaataccatggtatcctctgtgaataatcttgatatgcagttaggggcgttaaagtccacattacagggggtaaacagcagtacctataatcttgacagtgctgttgaaaatatacgatcttcatcacagactgagcaggagaaggcagatgatcttaataaactcagtaaagaagtggacaactttattacagtaacggtaaaccgggatcaagcggcgaaagaggaaatcaataaagcaaaagaggatttttatacaaaatattcctatttaaaaccggagtgtgagaaggattttattgaaaaggttgtagataccgttgagagtgcagcggactggtgttgtgaccactgggaggtgatagcagcaatcgcagcggtaatagtagtagcggttgttgtatgcgttcttttgggaccggaagcattggtgccattggtacttaatatcgccaaaggagtactgcagggagcacttcttggaggcgcacttggaggtgcattcagtgcctttatgggaggcgatattgttaaaggtatcaaggagggggctttagcaggaggcgcattaggtgcacttggcgcagttggcagtgcgtgtggttgtataattggatgtgaatctgcttttggaattgtatctggcagtataggaagattaaccggtggaattgcaacggcaatgtttgattttgacatcgtttcaatgatcggatataagattgatggggaaaataataagatatatcagataaataaagaatgccatagtaatcagatatataattttttccaaagagggataacagcaattgcagcatttaccggtggtatgagctccgctatgaaatgttttattgcgggaacagtaattgtaacagaaacaggatttgcaagaattgaggatgtaaagcccggtgatattgtcttatcaacaaatactgatacaatggagaccggttgcaaaaaagtacttgagaaatatgtgcgaaagaccagagaacttgttcatataatagttggtggaaaagaaatcgtatcgacaccggatcatccatactatgttgaaggaagaggatttgttaatgcctgtcagctttgtataggaagcccactgctggatgcagatggtaagatacttgaagtcgagcagatctataaggaacagcttggaaaaaatgaagaggtaaaggtatacaacttccaggtagaagactggcatacatatcatgttggtgagatggaagtgctggtgcataatgcggagtatgagaccagctatgggaagtcaagtctaatagaattaaaaaatactgataactttatggactcaactatagaacatatttttgaaggaaatgttagaagagggaaagcaggaggttatcattatgagtgtattaaagatactgcaggaaatattgttaatggaacagaagtattaataaatgatttaggggtatataaggcacaagttgaggttaatggtattccaaaatctggaaatgggggttattcaacgtttttctctaaagaaatgagccctcaagatgtgattgattcaattaatgaggcttataataacaaagtgtttgtagttggatctaaaaattcatatattggtatatcaaataatggattagaaattgaaatgtatataaataataatggaaaaataatttcagcttttccaaaggagtaataatgattgaaagaaaatatgtggaatatgaacttgcaaaagggaaaaaagatatttgtatagtatgtaattgtaaaaatgcagaaacgcttaatacatttttgtgctctgatgttagaccatttgaagaatggattaaatcagattttgataaggtattgtcaggagaaatcatttcaaaagagataagtggaaatgtttgttgtgcggagataaattttaaaaacacaaaaatatataatatgttaatagaggatgatgatgaatactatgaaacttgttgtgaggtggatacaaaagaacttcgtcaattaattgatgagtggtgtgataaagtccgagaatttaaaatgagcatcacaactaagcctccccaccagaaggcttaaatcctagtcttactaccagacattaacagaacttcttaggttcataaggtttactatcccgtaacacggcataaattacggtggtaagctttcttgccacggctcctgtggcagttaagtgatgtttaccttggtcacgtttctttttgtaatatgcattcaacgggctattgtgaaaagagcaggtggtagccgcaagaaaaatggcatgtcttaagtaaggtgaaccacgtttggacatgtgattatgagtgctgctaaattcaccggattgtcgtacagttggatcaatatctgcaaaggcaactaaggcagatgaactcttaaatctgtttatatcaccgatttcagcaagaatggttgcagcagcaattatgcctattcccgggattgtatgtaagtaacaatcaaactgctcatagtatttcatgatttcaatatcaagagcttcaatctgcttatcaagaaaattcattctgtcaatgagctgttttaactggaaagagaaagcatcctgtgctatcttaataccaaaggtatcagctgcagcttctttgatggaaatggctttagctttggtaagtcggttgtggctcttatcttttatgatttcaaagagctcatctattggtgcattctcaatattctcaggggtgagatacttttccagaatgcccatggatgtgctcacccaaagagaagaaaactgtttttcatactctgggaagatttgttccataattgtgccgattcggagcttaatttcagttctggaagaaatgacagaatcacgataacgacataactgacgcatggcaaggatgttttcatcagccatggaagtagtcccaaactgaccgaaacgtatcacttctgcaatcagaaaagaatcgatggaatcgttttttgtctgccggatatacatctttctgagggaatcagattggatgggattgattacatagatggtatatccttttgcttttagaaatgaataaatgggataccagtaatgacctgtagcttccatgccaaatacacaaggggaattaccgatgtttttgaagataaagctcataagagaatctgcacctttgtgtgtagttgcaaagcgaagagaacggccgatttgtttgccttcaggtgaaacaatggatgcttcatgatgatttttgccaatatcaatgcctacgatgtacataattgaaatcctttctaatgtgaattgtaagtagatagaatcctcacttcaatgcgggttacaatctggttagatatacgaagtacagcacaaatgctgtcaacatccagctaatacgcaaaatcctgcaaagcagagggggcagtctcaatgaacgaagtcacaagtgcttcaagagtggtgacgcacacctctatctattacaggataattgtgaaataggaataaaagaaaagcaatagatagaaaaagactgctttgattcctatgtgtttagcataccagagtggtagtaagacaattgatgatataattgacggcttgccagaaactactaacggaaaaggtgttgctaggaactttgaatcaacaggtgattttgaacagacaattagggattttgatgccctcaatcctatcgacgtgaaagaaactcaaacaaaatatggatcaggaaaagtcggtgagttgagtgatggaacaacagttgttgctcgtccaggtagtacaacaggaggagcgactcttgaaataagggtgtccaataggaaagtgtacaaaattcgatattaggagagataaaagatatggaaaaatggaaagaagtatttgttggtataattccaaaagcagtttaccaagtgcaactaataaatggtgagaaacaaggactaactataaaactgtcaagtagtcaaacatgcgtaatgattaattttggtatgattcaagcagtacgtatgctagatgaaggaattgtgcaaagtaacctttattctgaaaatgaaatacggaaatataaggataataattttcagaatataatttatgaagtgcaagatggtgaattttcagaacaaataaatcaaatttctgatggttatggagaggctttaaatttaaaacattatgtagtgattactcagaattacaatattgatattgcaaccgaatgggaaccaacaatagaaatttcaaagatgtaataattctggacgtttctcttgacgatttcaaacacccatgttacaaggcattcagcaatcccaataagttatgtgttgtattaataattccataactcatgctttgtactggtagaagtaaagattgttcctgcaatagtaacaaaccattcacagtttagattggtttggaatgggctttttagatctggatctgccatgtgatatccgggatatcatcgcggatgtaaggaatcttgccaaagcagatgatataaaatgggatatgatcgccatgcttgcgcttgatcttatcggggtaataccggtgatcggtgcattaaaatactcggacgaaataggaacactgttcaaaaatgcagataaagtcagtgtggtggcgagaagtacagatggtgccggtgtgctggcaaagcatgcagatgaggcaggagcatggctgcatggggtaaaagtgttcaagtattcggatgagacagccgaagcagtggcatctggagaaaagctgttaaaggaaagcgggacaatatatgaatcatttgccgatatgatgtcaccggaggatgcaaaaagatatttggattttctggagaatggaagcagagaaggattgacaggtgccgagctggcaggagtggaaaaggcagatgcattgctggtatcccagaaagttgaatatgaggatgtatgggatttaaggaatgtgggagatgcgcttgagagtggtagaaagggtggctcagtacctggtgtctatacagataaaatcaagtggggtatacatgagattgatgtgcgaccagatggaaacggattttggggacaaagaataagacaaaacaatcctagagtagatggatatgagttaaagataaatcctcaaaatgagagttattacttaccgcatcctgaaggaggatatgttcagtttgaaaatatgattaattctactgtgcaagatggtaaacttgttatgcagcaaaaatcgttttatcatgttaatgatatgcctgattttgcaaagaataaggtactagaagaagcaagaagacaaatagatgcggcaggtgcggcagattataaggtcgaatggcttgtatcagatgaaagtgccgtaaatcagttaacggaatttttcaaagagcataatgtggatataatcgttacattttatccagaataggagaatttatggaaataataaaatgcaaagtcgaagagataatagttaaagtagggtattcatacaaagaaaaatattcagataagcaactaaatattttacttaattactggtattttttcgatgaaaaagaaaaggaaattcaagaactattaggagtatcattagagagcattctgtatagcaaatattattggtgtacacaatataaaaacagatacaatgagttatatggaaaagatgtgggtatagatcagcaacagtataaaatcatcgaagaaatgacgcaacgaataaatgatgtggattggagttttattcagatgatagaagaaggaaaaaccaattaaagaatttgaattaaaacaaaattacgggtgaaaagaaacgggtgaactcatgacatttccccttgacggagcctatgaaatttttctgtaaaataatcacgataaggtccttctatgataaaataaatatcattaggagggccttttactatggcaagacaaaagaaaccggttcacagagttgaaatgctgtcaacatccagctaatatgcaaaatcctgcaaagcagagggagcagtctcaatgaacgaagtcacaagtgcttcaagagtggtgacgcacacctctatctattacaggataattgtgaaataggaataaaagaaaagcaatagatagaaaaagactgctttgattcctatgtgtttagcataccagagtggtagtgcatcaggtaaagtatgggattactctaaacaatttgatggtgaattagctaactttaatgctggatatgagataaaaaacgttatcgaagaagatttgtatttagttcaatttcattctaatgttgaagttggtagtggaagaagtttgaaatactggactacttttgatgcggcaaatggaattcgtacagtagatgactacatgaatcaaatggcgttattgagtaactggggagcaagagataatgtatctattgctaaaataccagcagaaacaaaaattaaatatgcaattggaactgcaaaggaacaagttggagcaatagaatcaagacctggtgggggactacagatactatttgagaaatttgatgatggctggattttggatacaaaatcattgccatagaaagaagaaaatatgaataaatatgaaatattagaaggaaagttgactgctataaatgcatatattgatactatgtgtttagaaagtaatgttacaatggaatatttgaaacagtataaggaatacgtaaatgaattaattattgctattcaaaatagaacaataagaaattcaaatggtgctgtgatgggacttattagaggggtttcagattatgatgaactttgtgccgatgatactttttggcaattagtaacagatgcagataattattattgtaatgagtgtcaatcattttaattatgtttccgcataaggacaaccaccacaaaaattttcagtctttaaattaatcgtaatagctgtcgtcgaaggggatgtatccatggggattgatttaaagatatgtgggcgaaatttgcatctgggtgcacttaaggacatccaaaataaaaactgaatattgtttcttcaaagatgtagaaatatactagtacaaatagaagtcataaatatgagtgaggaaataaaatgaatattgagaaagcagattatggaacaattgttaaatttggtacactaaaagacttacatgaaaaaataaagataaaaaacgataatgtagctgatatcattaattgggtagatgatagtggcattagtcttcttgaaagaagcttaacatccagaaaatttgaaatatcgaaatttttacttgataacaatgcaaaagtaaatatagtgtcaaaggaaggtaataatgaatttcattttttggctcctaatataaattgtatcgaagcagttgaaattggaaaattattgctaagtaaaggtacttcagtaatgcaaaaagatgtaaagtatggtaatacagcttttttttcgttatgcatggaagcttttaaggaacgttcagagagtacaatgaattttattgaaaaatgttttgaacaagtaactgatgttgatgagaaaaacaagaatggatttagcattcgcaaactgattatggaaaggggaagcgatgaacttaaaaaaagattggaggaaaaatatgcatagcacaatgaacttaggaggttctgttgtttcaaaaaatatattagaaaaaagaggacgagtaaaatggtgttttagagaagagagtgtaaataatattgataatgggtggagatttctttcggaaatagatacagatgaatttctggcagattcaaaaaacatggtcatttgtgattggggcacaatttttgaaatagagcctgcaattgctccaatttttgaattaccaattggaacagaattgaccttagagtatgatggctcacaaaaatattttgtaaaatctgaaaccggagagaaacttatattttaattaggggtatacttttggactcacaacaacctacaactcttgcacgtctattgattaactatcatggctgttgcaaagtaattaagaatccatgatgttaattaattgacaatagcgaaattttgtcgggttgggtatatggacgaacatagcgaatttaagtataaattaagggatgaattaaaaaatatgcaaaatggattttgatttacatattgatgaaaatgaaatcccaaaagatatgttaaatgggatgtgtattcattttgaagtatctacaatagatatttggtaatttgagacttggattaatttttagaacgcattgttttcatggtacttgctattgtgaagatgatgcgtttatttatggtgcaggaagtataagagcagaagacgtggcagagcggtggagtgatcggggactatatcaatgacatcaacagttaccatttacatatgtttgacaaacatgatgtgacaacaaagaagtttgatgctatagtagaaaaagcagggaaagtggatgcaaactatgcggcacagatagaaggatactgcagcctgcttggagaatacgggaaaaaatttgaggctgtatgtgccatgctgcagccggagaaactgagattatccccggataaataccgcgaaaagctggaggggatcaataccggctatcagaatgccaaggatacccacgagcaggaacagtcggattatgaggcagaactgtatgagatagagactgtctggtataaaaaaatgctggacaaagcggaagattatctgatacggagtgccgaatgtgttgtcctgggtaattttacagatgaagtgacagtacttggagtgggtgtgcagattgtccttggaatttttgatctggatttgccctgtgacatccgggatatcattgcagatataaagaaccttgcagaaacagacagggtaagatgggatctgatcggaatgcttgcacttgatcttatcggtctgatcccggtaataggagcactaaagtattcggatgaagtcggaacactgtttaagaatgctggaaaagtcagtgttgttgcagaaggcgcagatggtgttggagcagtagcaaggcatgcagatgaggctggagcatggctgcaaggggtaaaggtgttcaggtattcggatgagacagccgaagcagtggcatccggagaaaagctgttaaaggaaagcgggacaatatatgaatcatttgccgatatgatgtcaccagatgatgcagcaaagtatctggattttctggagaatggaagcaaagaaggattgacaagtgccgagctggcaggagtggaaaaggcagatgcattgctggtatcccagaaagttggatatgaggatgtatgggatttaaggaatgtgggagatgcgcttgagagtggtagagaatcatcaataatggattactcaaatagatttgcggatagtttggcagaggattttaatcctggtgttgaagttagagatgttgtaaaagaagatatgattttggttcaatttagttctgatgcgccaaatgcatcacttaggtattggacaacaattgatgaggctaatggaatttctacaattgaagaatatatggataaaatggcgttatcaaaagaatggggaaatcgaaatgttgtaaaagttgctagagtgaagaagggaactgaagttactcatgctattggaacagcaaaagcacaaactaaaattagtgatcctagacctggaaatggtcaacaaattttatttagtaagtttgattcaaattggattacggaagtaagaaatataaaggaataggtgttaaaaattatgaaaagagaaattatgaagaaaaagttaaatgatttacaatgtgaaataagaaaaattcaagatggtgttgatgattatacaagagagtatcttaataaattggaaaaaattatagaagagtataaaaataagttggattcaaataaaatggatgcatcagatggtgggacattaggatttagaagagcaatactcgaggatgacaatctcgctaatatagactctttgtataatgcagcggtagcagttgataaattttatagtcaagaatgtagagagtggtaaaaattcttttggaaattatagtactaaaattgactcaaaggtagcagtggttgaaaaacaagaattgcctagttggttaattgatacatataaggatggtgtctatcggacagtagtagccaatgaagatatcacagtataccgttcctttggatataatgcagaagcaggtggtgcgtttacaacaagtagtccagctttaaatagagttcagacaaaagttgatagtgcaatattaccagagtggaaaaatacacttaggtatgaggcggagattgttattcctaagggtacaactttgaatataggacgtgtaggtgagcaatttactatgagtggaacaagactcgctggagatgcagaccaatttttgttaccacaaaattgggatttgaattggataaaaagaataagagaagtaaaaccataaggagacgaactatggatgaaaatgtaattgaaataaaaaaacaagttagaaaagtaattgaattgttggaacaacgtataatacttgagcctggcagacctattctaaaaacattatatgatagatatatgaaagctgaagaaattatatcgagtaatgaagatattagtaaaattatgattagtggtgggtgtagagcttatttagatgcatttagcgattatatgaatcctttattaggcgaaatggataaagcagagaaaatgctttctaatttaaaaaaatagtgttgacaaaggatgtctggatactttcggacattcgataacctacaactcctgcatgtctattaattaactatcatggctgttgcgaagcaattaacaacccatgatgttaattaatagacactagcgtaattttgtcgagtagggtatgcgaaaggacattgtgaaaccaatatgctgatgtaacgcactcttagtaacagaatgctgcgaaagggtgcgtttttctgtgaaaatattataataaactgcaagcatttatgcagatggcagaaggactagccagcgtgatctgaaaggcagagtgacacagtggacagttatctggggtcatggagaatggcaggcaacaggacagagcgtatccggggagcagttcatgagcagtatctttatgatgaatgtaaccgcctgttacagataacagatggtgcagatacggttaagaactatacctatgataacagcggaaatatgctctcagatggagaaatgtcttatctctatgacggtttcggaaggctggagcaggtgactaaggcagacggaagcttccagaagaaccattatgacgcagagggactgcgcgcagaaatggaagaaaacggacaactggtaaaattcctctataatgagaacagggaagcagccgctgaagaggagtccgatggcaatgtaatccgctatatccgcggactggggctgatcagctctgacagtgagaaggcgaagacctattaccattatgtatctgatgagcagggaagcatcacccatgtgataaatggtgaagagaaggaaagcggggagcttccacaggaggatgtacagtcacgtgtactcaaccactatgaatacgatgcattcggcaataccatcagatgtgaagaacaggtgcacaaccgcttccgttatacgggagagcagtacgacccgttgacagggcagtattacctcagggcaagatattataaccctgtcattgccagatttacccaggaagacacttattacggggatggactgaacttgtatacctactgtcagaacaacccgatcctctaccatgacccgacaggacacggtacgaaggagaacagcccatacagcaggaatgaacagcggtacattgatgcaggggcagacccggatacagccagactggcagcacagtgctaccctgatgcgaagtcaaagcaggatctgtataataagtacaagaaacagggctatagtgcacaggatgccaaaaaattggcaaaccgtgaaatcatccatggagaagaagcaacaaagaagtacataaaagataacaatgtaaagaagagcggtcctgactatacagcaacctctccaagagataatgttaacaccgactggagaacccaggaaagagtgaatgcgcagaggaatgccggagctggtaaggggaatgaaagcggtaataagaccagagtggtacttcttcattgatagacattgatgcaatacgccccaaattaaaaactcaacctgacaccgcatttttctggtctggacgaacagatggaataggtggtgctgagaatgcagcaaatattgctaaaagtcgaggcggagttacattagagtctacaattgaaatccaaaatattgttatgccagaatgggatttcaataatccgagtacgatggaagcatgggatttggcatctggagcatatgctgaacaggtttcaggagaaatacgtgcagtcataggttcagaattaagaccaggtaatatatgggaaaatgttgagttgccacgtcttaagaataatcctaatgttacaaagataacaacaattgaccccaaaacaggtgtagagaatgtcgtttttgagaggtgagaaaatgaaaattgcaggtagtatgaattatgttaagtttgatttggaaaatgggtatgttataaaagcagaaggagaaatgcttgtagggagaaagtttgtggcgtatatggacactatgaaaacatgggagccaccacatgagaatgagaaaattagtaaagaacaaatagaaagaatcattcaagaagtacagaaaagtatgaatgaaaatacggtgcagattatttttgaataaaacctgctatgtttctgcataatagtatttattatggttatactttcggactcccaacaacctacaactcctgcacgtctattaattaatcatcatggttgttgtgaagcaattaagaatccatgatgttaattaattgacaatagcgaaattttgtcgggttgggtatatggacgaacatagcgaatttaagtataaattaagggatgaattaaaaaatatgcaaaatggattttgatttacatattgatgaaaatgaaatcccaaaagatatgttaaatgggatgtgtattcattttgaagtatctacaatagatatttggtaatttgagacttggattaatttttagaacgcattgttttcatggtacttgctattgtgaagatgatgcgtttatttatggtgcaggaagtataagagcagaagacgtggcagagcggtggagtgatcggtgactatatcaatgacatcaacagttaccatttgcatatgtttgacaaacatgatgtgacagcaaagaaatttgatgctatagtggaaaaagtagggttatctgatgcggagtgcagaatgtgctgtccttggaaattttacggatgaagtaacgctgcttggcgtggctggacagatcacacttggaattttagatctggatctgccatgtgatatccgggatatcattgcagatgtaaagaaccttgcagaaacagacagggtaagatggaatctgattggaatgcttgcatttgaccttatcggtctgatcccggtaataggagtactaaagtattcggatgagacagccgagtcaattgcatcaggcgaaaaaatattaaaggaaagccagacaatatacgaatcatttgccgatatgatgtcaccagatgatgcagcatagtatctggattttctggagaatggaagcagagaaggattgacaagtgccgagctggcaggagtggaaaaggcagatgcattgctggtatcccggaaagttgaatatgaggatgtatgggatttaaggaatgcaggtgatgtgctggagagtggtagtaagggtggtttatcaacacagggatattcggattttgctgatggaatgttaccagaagatgctacaagatgtattttaaataatgaaaaagcgttctttaatgagttttctgaaagagcaagtgcggtagggttgagcgacacgcaaattgcagaagcctttgaggcaatgaaaaacggtgattatgcaaaaatggcaatatattttgatacttcatcaccagttgatggtgcagtattttggagtggcaataaagaaggcgctgctgcatacgcaaacagtattggcggaactataatggagcaaactccgggtgggcaagtatttgacaattggagaggattgggtggcatgtatcctgaatgggatacacccacgaatctagctcagaaaccaatatgggatgccctgtcaagtcaatatgcaaatggcgcagaaggaattgcgacatatgctcatcctgatggctatgtgggaaaagtttggtcaaatatagaaaaaccaatcctagaagaaaatgatattattattcaggaggtaattatagatgcaaaatagtaaagcttatgattgtttaataaaacaattgaatgcaaacggatcagaaaaaatggatggatattatcctgaagtgatggaagaaatatatgattgggagcgggaagaagtagaagatattatttgggatgctttttttaataaaaatgaaatagaattagcacaattttttcctaagttaaaaaaatatgatggtatcaaggctttaaaagaaagcccttatttattacaaataccaagtgaagcaagtgttgaaattggtaaaatattgtatgaggctacgggagatgagggatatttagatataattaaaaaaaatattgatgcatctccggaaacgatatcatttgtttcaattttgtcatattgtaagccttgtcagcgattatataacattcttgtagacatttatattaataatagtaataaggttaacaggagtactgctgttatgggaattttatataataaagggataattaaagacagaggtagcattaaagaatcaaatgatgtaataagtttgcgtaagaaattcaaatccgaagatagtatagagcgccaaaaaattcttgaaaaatttgaaaacggagaattaaccttgtaaatttggttagtgtatcagcggtatttaagacttaaaaaagttatgaacttttttttaaaagaaggaccgatttgattttctaattcatttaaaagagcagtcagaaaagctttacggaggtaggtagaattgaaatgtcttatatttcgccaaaagccatcgtcagagaatccaacctcagtaataagacaatgaatatgaggattccattcgagaggtcgtccaaaagtgtgtaatatacaaacaacacctggaacaaattttttggatttgtttgctttataaaacatatttagaacaacgctgcggacagaagaaaaaaggcagttcaaaagagaacggtcttcaagaaaaaagtgtctgagttcttcatcgatggtaaagacacaatgacgatgaggacatttaatgagtttaaaagacatggcagtagcacgaggatgaaaagtatattgaattatttcatagttatctctaaaaattttttgcaaagcattcatgagataattatgaaacaaagtaaccaaaaagaaaacccctaaatcccctcatgaatgagaggtaggggagttgaggtgtcgaagacacttttttacaatttcaatatgaattttagaaaaatattaaaacatatcaatttaatgataactaataaaattgagataaaaatattgaaatacttgacattttgacttgtatttataaataaatatgcatataataatagcaaacaaatttggagatgagattatgctgatagaatttagattcaaaaattatagatcatttcgtgatgaggcaacattgtctatggaagcgacagggcttggaacattcaagaatagtctgattaagtatggtacattgaatttgctgcccagtgttgctatatatggaaagaatggtggaggtaagagtaatgtgattcgtgcattctggctggcagtacaatttataaaaaatgcccagagaacacagcatgaaaatgccagaattccagtaattccatttgcattaaatgattattcaaaagatgaaccgacagaatttgagtttgtgtatacactggaaggaattaaatattggtattcctttacagcaacaaaggagaaggtatataaggaatctttgtaccatgcaccaaaaggacagaaagcattagtttttaacagggagaatcaatcctttaattttacagaagaaaaagcaaaaagaaagctgattagtgagactgttgctccaaatcagttgtttttttcaatggcttgtacaatgaatgacatagcttgcataaatgcaatgaagtggtttcgagagttgctttatttttcaagagattactccgatattccaaagcaattattggattattcgaatgataccaatatgttacaggcaatttctgattatgctaaagcagcagatcttggtattgaaagtatgcagtttgaaattgacagcaaagaagttaaggatgatttaagttttccagagaatatgccggagggggtcaaagcagcattaactcagttcatgcatattctgtcggagacatcaagtaattctgaaacaagacttaagatgaatgaagtcaaagcaacatcaaaacatcagggaatcaatgcaaaaggggaaaaggtattatatccgctggaattgtcagatgaatccgatggaacgagaaaacttatgtccattgcaccagcaattgagtctgtgctgaacaagggaggcgttcttatcatcgacgaaattgaaaaagaacttcatccaatgcttgttgattttgttgtggcaaaattccagagcaaacagtcgaatccgaatggggcacagcttatatttacaacacacaatacagaacttatgaatatggaaatactccgtaaggatcaattgtattttgctgataagagcagtgaggacggaacatcagaactttatagtatcagtgaatttggaaccagaaccacagataatatcagaaagggatatttattgggtaaatatggagcaactcctgatattgagatagaggaggtggaataatgcctcgtaaggtaaaaccagccaagcctttgatatatgtattctgtgaaggtgaaagcgagcaggcatataccgattatttgaaaaaaactttttccgatgttgcagtcctgaaacggccaccggatactggattatttgaggaagcagaagcaaagttttcaaaatcaccgaagtataagaacagtatagaggtaacggatgaaatatggtttttctatgatgtggaagaaaaggatattccaaaatggaatgacagacttgcaatcataaagaaacttcgcaaattgagaaaaaagcagggaatacgagtaaggctgctaatgacgagtggatgtattgaatattggtttatgttgcattacaaatattatactccgaaaatcattactgttcctgaaaaggaaagggttattagcgaagtgaaaaagcttgttccaacctatgcaaaaggggattatgcagcaacagagaaaatagcagtcaattatcctaaagctgtagataattcaaagaaaacagtgaaagcattattgccggatggtctgccagagctagaggatacagatatcagaaaccaatggttaaatacaaagagcgttacattttctaatgtatatgaggcgatagaatttttgcagaatcttgcatgatttacagtgttcatattagagtgtttatgctaaatcgattgaaaaatattttgaagcagatggaggcagattcaaattgtatatagaactggaaaaggagccctcgtcaaagctcctttttggctgcgagcagagtctttgttgctgcattttcaccctttaattggatatagcctacgatcatatgataaaaatattgtttctcatcaggagtaagttttacaagctgtgcccggatatctgtcataatttcatcatctctggtggaaatgtcatcagatacaacataatccacacttgcgtgtaaagcattgcataatgcgatagtcgtttctaaacttggggtacggtcaccacgctcaatctgtccgatgtaattagttgaaacatcaacggcttcggctaagcgagcctgagataaacaattgttgattcgtaaacgtcgtattttctttcctaaagaatctggttgcatgatgccttctccttttcaatacagtcaatcttatatgtttataatatatattatatccattatattaatgcaattaaattaccgagaaaacacacaacatgtttgacaaaagatgacaaatagtgtaaaaacatacaattattgaattaaaatagactgcaatggataacaatacacaggaataactatttgcgtgataaaaacatacaaattgcttgattgtggaaaggggttggggtattatagaagtgatagataatccggtattatctaccataaaaattggaaatggagggtactatgaatattgtgttgggagttcatgtaaaacatgacagaagtgcatgtatcattattgacggaagggttgttgttaatatagcgaatgaaagattagaccgagtgaagtactctgactctcctgaaatcccctatacagctgttgatgctgttttgaaacattgcaatattgatatttcacaggtttcatgcattggtatgtccggcgcaggaatagaaagtgaaaaggtaaaacagttctataaggatgactttttcgctcactatagatgtcgcgaaattccttttttctttctgtcacatcattgggcacacgcatattcttccttttgttcgtccactttttccgaaagcctgatatttgttgcggatggtggaggtgactatatcggggataagcaagaagctgaaactttgtattacggtagtcacggaaaaatacaaccactcgccgcacggacacaggatatggttgtgcgcaaaatggaaaatccagtaaatactatatatccttttatgccggattatgtacgcaaccatcaaattagtatagcacgaaaatatgcgcaaattacgcatttgactggctttgcacatggagaatgtggtaaaacgatgggacttgcttcgtatggaaaatcttattttgattactcccaattagattttcgtgatttagattttgatttaaagtataaggatatgttagaagaaatttacgcattgcatatcatgtcaggaaagtctcatagagattttatcttgaaagaacgtgcgaatatatctgccacagttcaagagtttacagaatgtgcaataatttcgctgttgaagaactatcagactcgatacgcatgtgaaaacttgtgtcttgcaggtggattatttttaaactgcctattaaaccataaaatactttgtgaatgtaattttaaaaatgtttttattattccatcggctggagacgatggtcaagctcttggcagtgcatactatgcttacatggaaatgttcggaacacaatccgattttcacattaatttaccctacatcggtttagattataccgagcaagaaattgaagatgcaatccgattgaaaaatctttcctacaaaaagtatgcagatggtgatttggcaaagataacagcagaatatatatctcaaaacaagattgttggcatgcacagaggaagaacggagttaggaccgcgagctctatgtcatagaagtatcttggcaaatccaacccatccacacatgaaagacatcttaaatcgtcgcgttaaacatcgtgaagaattccgtccttttgcacctacggttgcgaaggaggatcagttcaaatattttgcattacgggcttcctcagactatatgttacttgcgccagttgttagagaagaatatcgcgaaaagttgtcagccgtgacacatgtagataatactgctcgcgttcaggcggtatcaaaaaagagcgatccctttatacatcagctattgcttgaactgaaaaaagttataggggtatccgtggtactaaatacatcgttcaatgttgctggagagcctattgtcgaatctccgcaagatgcgttaaacacttttttgaaaactaacattgacgttctagtaataggaaactgcgtagtaactaagccttagaggataagcagatagcgtgtttgcgtatcccatagaagattgggtggggtgttttgtgcaaataatatctctctttttctcgcctttgcatattgctgtactagaaaggtattaaccgggttatcggatagattttggtttggatacgcagagtattcttgccccgcaaacgtaacaagggacatcgtttgatagaactgtgattcaaatttacgttcttgtaaatagtatccgatattgcttaacgccaaaatattcccttcgcatgcatcacgattccctatatatagaagcccttgctttttcagtatatcaaatactgtgaaaaaaattttataaatatgttgagagtcgaaccccattcgtattccaataattgcttgcaagttatataaacgccacaaatatcctacaattccataagatgtgctgagattaatagctctatctacatattctttcgctagaagggttgccttttcttcgcctttcaatagattgcatattgcaagcaagaaaaagcagtgaatttgagcgcgatgcagattgtttgcttcaatatcttgtaacattgaattaagctttaaaatcagcttgtcctgatgaacagtagaattacttaatatttctaatgcacaaacatctagagaattatctgtttcaatccttttggatggcatcagtgcagttgcttctatggactttcgcaagctttcgctagaaagatccatattaggatatagagttattttaaattttgttctatatgccaaggctcttaacctattgtcatccaatttgtcagctaaggttattgacagagtattatatgtcttagataagtctattaaattgaatgcccgataaactgctgccaatctatcatatagatcgaacaaagtttcatcagataatatttctttattgcacaaccaatctgcttggatttcctttagtaagatttctccgtctggatacaagcctgcgttcattaaggcatgagcttttaattccataatggaaagacaaaatggtctatcatctaccatcttatattgtttaagtttttttaacacaatatcacattcatctactgctttaatcggggcaaaatgatgaagagtgatatatactcgcatcagcaatgccttttttgctagaggtaaatttttgcgagcatgtcgaagcaactcaaacatatcatctaaatatttataataatttaagtttacattgacatttgaaatattatccactgcgattagccatgtttcaatcgtgtgtagatattctcttgccttcttgtaatctttgctgtataaatagagtcttccggtttgaaacatacctaaaacatgatcaatgtttggcatggatacaatctcttttgcgagaaaagttcttattgctttttttcctttcaactgttcgctcacgtatagaaataaactttcgtgaacaaaagcaatcgtttcattttcttcatattttaataggcgccgtcgcatcaattcattcaattgatcagatgaatcctcaaaaaacatgttaaataacgcaaggttcattttaccattgcataacgcaattttgtacaatagattcaaacaggtttcgccatctttctctttttgtagatgagaaagcctctgatagtagatatctgcaatctgtgttggcataaaacgttttacatggaatttgttaatatctataatgcctaccgtattcctattttgaatctttaccaaactacaatccaacagatactctacatattgaacaataaaaagtgggtttttcgcacttagattaaataaacggtctaatgcatatggaggtataccgtcaatcaacaccctaattaaatttttagcttcatcatcagtaagcggctctacattgaagcacgactctggcaaattttcatctgcccattgaacaaacgacaagtaattgatgttcccgatggtaaaatcggttcttccactaatcagcaacgtgattgaagataggttagactttagcctttgtatttcgcataggaagctatcgtctgcattgtgaaaatcatctaaaaatattaccgcttgattcccaaacggagtcctacagttttctatcatagaaacaaaatccacatactgcccctcttgtatgtatccatgattaagcagaaatctttcaatttctttttggggagtatgaccctgttgaagtttacattcataaagatcaaatagcgtgccctgcaatcttgagaacaattcttgcacaagtctcgttttaccaattccggcatccccccaaaagcagacaatgcttggtggcatggtcgactttagcctttcctcaaggtcgttaacaattcggattcttgattctccaaaaaatggaggttcaaaaatctgtgtgccatttattccattaatcataacaactgattctgtgccattaatttgaatgtgaaataggagctctgggatgccatcaaagtgtttttgttctaccgttacttttttgacggctgcaccactgggtgcaatcacaaaggatatattgtcttcggaagtgttccaatccacatctgtcctaagctgtaaaacacaatgcttttcattattggagtaatttcgaaaaagcatatataaatcatatcgattagttaattgtgaaactacagtatcaacctgatactcatagtaaaaatccgtatgatctgataaactatacggattattgagtgcatgttgcaactttggatcttcgagacttaaaaggtacgtgcccaataaatacccatctattaatcggaatgatatgttgcttctttccagcgacttagtcaaataccagtatgtttgcggcaaaatttcactattagttaccagaacataataatcatacttctcggtgtcttgaaattgcattctggaactactagaagaaattttatcataccttaaaatgctattatctgtacttttgcactcaaaacatatttggattcctttaccgttaaatgaagtaaaactctgacctaaaatattcacagtgttaattttggtggaaacaataacatcctttccaccatctgctacgcgccgtgtctggaatacttgtacttgtggatgtagctgacgcaattgtgccataataatttttgcaacaaaatcttcaaagttttgtcccaaatttgcttccatctgccatgttaaattgggagacttcccactagaatatcgcctcatacatttccttctcctatcacttcttatggtagataatttagaattaccccttatttctgtcaaatttattggataataccggattatcactcacttccctccaatccgtctttcactcaaatagaaaatccatttctcggatgtttcgtcgttagtatcattttttgtttggcgagcgtgacatgtgtataaatctgggtcgtagtaatagaactgtgtcctaacatttcctgtatgtaccggatatcgacatctgcatcaagcagggagctggcaaaggtatgacggaacatgtgaggcgtaatgtgctgatcgataccggcgagagaggcatacttttggatcattcttcggacactctgatcggataaaggttttccagactgatttgcaaaaaaatgaccacagttttctatttcgttggaaaaagtgtttttgtattcatttaaagtttttagcacgttatcgtttccaatctgcagtttacgttctttagagccttttccataaatcaggacaaaattgtcattcaggttgacatcgcaggattttaaactgcacagttcggaaatgcggattccggtggcaaagagcagttcaattacggcagcgtcacgcagagcatttttttgctggtaagatgtggttgcaagctgccgctggttgtatattgtggagagaaaaagttctaatgtctgtaacggaatggtttttgggagaataacaggttcccggaagcggatctggattttgtcaaagggatttctttcgataaattcataaaattcgcaatagtgaaaaaatgctttgagggatgcaatttttcttttggcagttttaggcttatatatggagtgcaggtgcgcgatataggattctatctgccgggaagcgatgtcgtataaggaagtctcggcaggcattgtggaagcaaaatgtgtgagatcaattttataggcgcgaattgttttgacgtctaagcacttttgtgatttgcaaaatgtaagatagtttgtaatctgggtatcgtgtaatttcatggtatgtgttcctcgctttttatttttatattagcagaggaaaagtggtctgctgaaaagaagaaaagaaaatttttgaaaaagcaaatttatattcggttaaaaatcattgacaatgtagaataagtgtgtataataaccaatgcagtcaaaatgcaaataatttgcaaatgcatacaaaatgcaaaaacaaattgattgcaatttgaaaaattaagattgaaacaaccaaatgcaggaggcgtttgttatgttacacattttagaacatacattatcacacacgatcgaggacagcgtgaagctgcttccatttctgtttttcacttatttattaatggagctgttagagcacacgacaggcggaaaagtacagaacaagattaaagatgcagggaaagtaggaccgctgtggggcggacttcttggaattatgccacagtgcgggttttctgccgcagcggccagcctttatgccggacgtgtcattacggtgggaacgctgcttgccgtatttttgtctacgtcggatgagatgcttccgattttcatttccgaggcggtcgcaccggcaacaatcgtaaaaattctcgcagcaaaagtttgcattgcgattatttcaggatttcttgcagaactggtttatgtgaatgttttcaaaaagaaagaaaaagatatggacatccatgtggtatgcgaggaagaacactgcagttgcgaggatggtgtcttgaagtcagcgttaaaacacacgttcaagatttttgtatacattctgctcatcacgtttatgctgacattcgtgatcgaattgatcggcgaagaccagcttgcggtagtatttcaggacattccggtggtgggagagatgatcgcagcacttgtgggactgattccaaactgcgcatcttcggtggtgatcacagagttatatttaagcgggattatcggagccggggcgatgatgtcaggacttttggtaaatgccggagttggacttttggttttgttccgtttgaaccgcaattggaagcagaacgctggaattatggcagcactttatggattcggtgttgtctggggcgtgatcattgagttacttgggattgtattttaacagatgtagatgaataattgatacgcggaagtatgaaattaagaggaaagagttaaaaattgtatctgctacagtgaaagcatatacagagaaagaaaagagatgaaaaaatggcaggaaatggttatgcaacgaccagcagaaagaaaattttagaatatctcatggcaaacagcgaccgcacagtgacggtgacggacattgaccagtatttgaaaaaacacgataacgaggtgaacatcacaacgatttaccgttacctggataaacttgccaaagagggaactgtcatgaaatatgtggcagagaaggggagccaggcggtgtatcagtacgtggagatgggacatcactgtgaggaacatcttcatttaaaatgtgtttcctgtggctgtattattcatttggaatgtgcgtttatgcaggaaatatcggaacatattttagaagaccatggatttaaactgcagtgtaaaaattccattatttatggactttgcagggaatgcagggaaaaacaggacagggaataatactgctataggatttccctataatcggctcatggttttatggattaacactttttcgattgatttgatatgataattccaacagcagaacctgagaaaaacagacaggcaaaaagaatgaaaacatagaaaaaggagggaaaaacacatgagcacattaaaagagagaaaattaaaatttgagacattacagttacacgttggacaggaagagccggatccggtgaccgatgcaagagcagttccgatttaccagacatcttcctacgtattccacaattcaaagcatgcagcagaccgtttcggtttgcgtgacgcaggaaatatttacggaagactgaccaatccgacagaggatatttttgaacagcgtattgcagcattagagggcggcgtggcagcgcttgcagtcggttccggtgcagcagccgttacatacacgattgaaaaccttgcacaggcaggtgatcatatcgtatctgcaaaaaatatttacggcggcacttataatttgctggcacatacattagtagattttggcgttacgaccacgtttgttgatccttttaacttagaggaagtagaaggcgctatcaaggacaatacaaaagcagtttacattgagacacttggcaatccaaactctgaagtagtggatatcgaagcactcgcagagatcgcacacaaacataaaattccacttgtcatcgacaatacgttcggcacgccatatctgatccgtccaatcgagtacggcgcagatatcgtggttcattccgcaaccaaattcattggtggacacggaaccacaatcggtggtgtcatcattgacggtggaaaatttgactgggctgcatccggaaaattcccacagctcacggaaccaaacccaagctatcatggcgtcagcttcgcagcggcagcaggaccggcagcattcgtgacaagaatccgtgctattttattaagggataccggagcaacactttctccaatccatgcatttatctttttacagggcttagagacattatccttaagagtcgagcgtcatgtggaaaatgcattaaaggttgtggagtttttagagaaacagccactggttgaaaaagtaaatcatccatccgtttccgaagatccggagcagcagagattatacaaaaaatatttcccgaacggcggcggttccatttttacatttgaaatcaaaggagatgacaaaaaagcgcaggagtttatcgatcatttacagttattctccttacttgccaatgtagcagatgtaaaatcccttgtcatccatccggcatctaccacacatgcggaattaaatgaggcggaacaggcagagcagggaatcaagccaaacaccatccgtctttccatcggtacagaaaatatcgacgatatcctctatgatctgcaggaagcgtttgacgcagtaaaataatataggccattttgataatttatcattcagaaaggattgcgcacagaaatgtgttgcagtcctttttatcttttcatagaaaaaaacattgcaatatagaagcaattcatatagtataaaatatgaaaattaaaattttagtttataaaaaagatttgggaggaaaagaaaatgaatgcaaaacaactgaccgcagcagaaacaattgtgatgaagtgtatctgggacgcagaccatgagatgtcactggcagagatcgtaaagaatgcaaatgagggatacggaaaagagtggaagccacagacggtatccacataccttgcaaaactctgtatcaaaaattatatccagatgaaacgagccggaagaacgatcacctatgaaatactcatcacggaagaggactacaagagtgagcaggcgagggagtttgtcgcattctggaataatggttcgctgaagcagtttatcaccgctttttataaggatgaaccggcttccaaagacgagattgaggaacttcggaatgctattgaggaattggaagagtagttttggggtgaaagaggtttattcttcttgataaagagcatatgacacatgaggaaaacaagatgagatatagaacgattgtaaatgatcaagtagtatatgaaagttattttgcctgtgtgtttcacggatagcgttttatggtgtaaggaaaaaatgccataggtgaagttaccaaagtaagatagatcagcaaacagaaggagtgcagaaaaaatgaaatttaaaataattataaattataaatcggtacgtgaatgttatatggcaataaatccgatgattcgaaaaattttatatggttttatcggtacatccttagtaatgtcaattgttttttattgttttcaccaaatagttttttcagcagcatttttcttgtttatatttgcgattattattgaaaatcaattcattatgagacatgacaccaaaatgatgatggaaaaaatagaagacttaacacatacaaatgaactttggggagagattgtatttgatgagtctgcattaaaagtaatcccatatggaaatacggagtctgagtattctatggaatatagtaggtttaaagatttttatatactgaaacattattgtgtcttcggggataaaagaaaaatcgaaaagggactgacgcaggaaacaatcatcattgataaaacagttttaacagaagcagatatgcataatttgacttccctgattcatgagaaaatgccacaggtaaaagttcatgagaaaaaaagaaaaaacagaggagagtaataaaaatggaatttgttacagtaataaatagaaaaaaatgcaaaaaaatatataaagcaattagaaagccaatcattttatttttactttattttgaaattttttttgctttgttttgttgtacggtattgttttatccggacaaagattatggtatgataagttttatggttataactacgttatttttcatatggttatatgtaatgtatagaaaaaaaaacattgatcagatgtgtccgaaagaggtaaagaataaaaatggagagtacatacaaaaagtaaagtttgaggaagatgaaatcgtggtatggagtagtttgaatgatacgacctttcatttggattattcaagaatcgcaaaatgctatgcgaagaacaatttctggatttttatgacaaaaggaaaatttgtttttgtagttgatagaaaatgtatttcacaagaggatagagagaagcttagagcattgttaagagtgaaattatctggggtaagaatgtaacattatggaacaggaatcatataagatgcctgttccatgatgttatttaaagtattgaaacgagtgaaaatatattcattttcttacagatatgagctattttgtgtggaggtttatttatgcagattaaaattgactgatccagattggtagtaactggagcaggcctgctttaatagctgtaagtaatgcaataccagcagaagtagataaaaaactgtatgttgcaagtcctgctaaaaaaagaatagacactaccataataactcgtgcaacagttttgtgttcttcgtaaaaagtgagaattgtctctgttatttcggaaagagcctgtgtgatctcatctttaatatcaggcatttcataagtcaatttatattcaacaccagcttcaatggataccccatctttgatttctaagtcttttgaaaactgaatagacatagaaaaggatttagcagttagttcaaaggaaacattacctgtacctgtattgatggacagggcaattgatttgaatagtgaccgaatatctgaaagaacacccatatctacggaactaaatgcaatcgaaagatcatcagcaacatcaagtgatggggtaagttcaccattttctaaattgatactaacaccatcagtattaattgccatgtcacgtaccattctgacagacagtgtcaaaccaggaattcctgtaggaactgtgcagccattctttaaaataccatctgtaatttcctcatcaacaccaagcgggagtaaaagatcatgaaaatattccgtcattttgaccttaatttcttcttccgtggcgtgaggtttattggaatgaataggtgtaccgccgttgtcgccatatccgtcaatggaaggatcgtacaggttataagttttacgtcttacaccatcactggaatttccttcaattgttgagacatgtgttgtagttccttcaattacaataccagtgtgggaaactcttcctgcctgagcattataaaagaaaataatatcaccaatttttggaacatagccatttccagaaatatgatagcgtccccggcttttataccagctgacaccggaaggacaccaggaatattttggtactaaagtgtttgtaattccggcgtaatgtgcacaccaggaaacgaacattgcacaccatgcatttccgtttagaccataccactgaccgtatggagtaatattattttcgttgtcctcatgatatccccaatccgcttcatattttgcaatattaagaaaacgctgaagacctgttccgcttacgggtacgctatatacctcaaaaagtttcgtccaggtagcaggaccaacctgaccgtcgggatctaatccatgtgcagtctgaaaggaaagaacagcattttttgtttcttcggaaaaaataccattaatggtaatctggtatcccagtacatttaacatgtgctgtaaataacgggctaatgcaccattggaaccaagcttctggacatatgaaactgttccggaaccatctgtacctccgagcagggcagctcttgtggctggtccgaccattccgtcagcagtcataacattatcagtctggtatttgagcactgcgttgtaagtatcctctgtagcgataccatcacatgctggaatatcataacctttatttttgagggcaatctgaattggagtgatatctgcacgcagtttttcccaggtatcaatatcaacaatgccggtagaagataatcccttttttgactgatagcggcttactgcactttcacatccgggaccgaatacaccatccgtacctttgggattaataaccataatgcgtaatgcctgctgaagatataatacattaggaccgcggcttcctctttttaaaggtagatcatcattgccgccttccacggtagttccaaataaagcttttcgtgtagcaggtccaatctgtccatcctgtgcgagactgttgtctgcctgaaattttacaagggcttcaccagttgcggcagttgcaatgccatctacttttccaagggaataattcagggacgaaagtttctgttctacttcaagaattttactttttaatgtatcccaggttgtcgtgtctactgtaccggtctgtgaaagattgtattttgcctggaattttgaaacggctgtttctgtaccggctccaaatgtaccatcaatagctccgggagagcagcataacattctcaatgcgcgctgcagataatttacataagtaccttttgaaccgcgtgacattggaagaactgcgtaatcgttggtcaaagtatcaaataataattcacgtgtcagaggaccaactcttccatctttatcgagatgattatttccctgaaattcaagtacgctgttgtaagtttcatcatttgcatagcctgaaacactgccatatctgtagtaacctttacttttgagtgcagtctgaattgcctgaatatcgctcatcaggcagttccaggtggcaggacctgccataccatcctgatccagtccgtttttaccctgatattttttgacgccggattccgtacctgcgccgaatgtggaatctatggttccgtcatagcagcacatgatgtgcaatccctgctgtaaccattttacataggttcctgtttctcctctttttactaccataatttttctcctttatgtgtgatatttgatttgcaaatcacttattaagaagcatatagtttgaagaatagaaaccagaaagtaaattttttgttatcacatttaactttgagcgtatatagttttaaaaaaactaagaaaatagtttgcgttttcttgcataaaaaaataaaatactgtaaactgaaaatatagtttacagatttaagcatcatacacattatctttagcatataggaatatctggttaagtggaagattagtatagagggaaagcaatatgagcagtaaaatcaaacagtactttgcaaataaagagaatcgtatcaagtgcggcatcataggcggaacgattgcattggcggtcattatttttgtaggaatggtgtttatggaggaaaatgaaactcaaaataattccatcgaaactgtttcacagacggaaagtgacacgcagacagaagaagagacaggatattctttcaacgcgggcgatctttacgatatgcggctggatgcacagacaatcgaagattattatatgaaatcctgtggcgaccagttcaatctttataccattgatgaggatggtgtgctctggggcagtggacataatgagtatgcgcagattggacttgggtatgcggacgaggaatttcatgaggaaaaaagtaaaatcgcggaacacgttgtgcatgtggactattcccagaaagattttgttgtctatctgacggaggaagggaaactttatggtcttggaaacgattctacctatatgttattgcagcatacagaaatgccagtggaagatttggcatatccgacaaaacggtatgtcaccagtccggcacttttgctggaagatgtcagttatgcgaggtgcggacgtgatgatgtagttgcattgaaaaaggatggtacagtctggacatggggaatgatctggaattatcagagtacgggatattgtatcacaatgccacagcagattctgacagatgtgaagatgatcacaggcggatggtttaaccacgccgcactcaaggaagatggaacactctggacgtggggatacaacttcagtggaaactgcggaacggataaagccacgatgattgaaacaccggtgcaggtggcagaagacgtgcagtgcgtgtggacaggacttttgaattattcagccaaagaggatgatattaccgatatggaagaattcggtaatgattatgtggataatacgatcattgaaaaaacagacggcacattctatgcatgtggaatgggtgtcggcgacaaaagtgtggtattgccgcaatattatgaagtgtcggagcttgacacagtctgctcatcagagtttcttccgctggactggaatgaagaaatgttgaacaggaaacaaagagaatacatcgagcgaaaggagagccagagcgaggaggctgttcttgcaagaaaaaatgaagctttattggaagagatagacaaaaactacgatatggagaaactgaaacgcaaagtacctcgtttttcggaggatgataagatcaatgaggcatattataatgcaatcaaaacactggatacaacgggattcctgccggatgggagatactgcttttatatagagcaggacggcagaacagatgtggaacgttttcaggaacagagggcacagcattatagtccggaaagagttgcggtggcagatgtggatggcgatggtacggcagaattactattttttattgaaggaacttgtgtgagagattcggcagaatatgtctatcggtattcagaagaaaaaaatgcttttgaacttgaatttgaatattcagcgggatgtaattattatcagaacggagtgattaaggcaaagccgctttactcaggttttatatatcaggatgatttttggccgtatagtgtatttcagtatgatgaaaataaaaacgagtttgtgcttacagccagtgtcgaggagattccaaaagccccggaaaatccagataattttccagaggaatatgataaggacggggatggaaaagtgtatatcatcagtcagggagaatccgttaaatatttagatgaacaagaatatcttgcatggaaaaaacagattttctggatgccggagatgaaaatagattggtgtgaattaggaagcaataaagagttattggaagagatagacaaaaattacgatatggagaaactgaaacacaaagtccctcgtttttcggaggatgataagatcaatgaggcatattataatgcaatcaaaacactggatacaacgggatttctaccggatgggagatactgctttggacatcagaagagtaatgtagatgtggaacgttttcgggaagatatggagcgtgcttattgtccgaacaaagttgcggtggcagatgtggacggtgatggcactgtagaattacttatttttacagtaggattttatatggcagatataacagaatatgtctatcggtattcggaagaaaaaaatggttttgaacttgaatttgcatatgcagggggatgcgattattatgagcacggagtaattaaggcaagtccgcttcattcgatgtatagtgactatcaggacggtttttggccttattccgtatatcagtatgatgaaaacaaattgatacgtgaacaatcggtgtcaggacagagaaaaaaacagcttaccatctattgatagctgcccttttctctggactgcacaccgatttttaccgattgaacaaaatcgcgtcactccagacgatacagtatggagtttcaatcgatttccttcttcttgattttaccaaagaatctatgcattggaaactgattccatcatatattcaaaatagtaacctgtcttatcgaatgaagggtgcacttaataagccttctttcaggaggctgtttttcagtattcaaattccttcactcaagtcaacatatagcgtcctcgaagcgatagtgaatgaagattttctccacaggcttcacatttacagatatcctttttgtaaaggatcatcagcttttccgcacaggttttgcctcggagttttgaaatatattgaatgcagttgagaagcttccggcagtgtgccatcttttcttttttgttcctgcaggaaagcaggccatagtggcgaattcggacaaaacctttagggagcacatgcatcagaaacattcgcagaaactctgttcctttaatggtttgttcgatatatttaccgccattcttgtaatcctttacgaggtaggtaacagtttcatctgtcatgctgacaattctacggttactgatagcgatacgatgagtgtaacggccaaggtagtggatcacagaatccgctccattgaatgcctccttcgtatatacaacccagttcttatcgtagagggaattcagtaaagctttgaattcataatgatttttcaaatgtgctgccgttccatgatactcaagttttttatcttcccagaattgtttcagctcacgaagataatactttttgaagacggcagacatgaccttaaccggaaagaaaaacttctttcctttatccttccacttgtttgcagcatcaagtccaccgccaagaacaatggtgtggagatgaggatgataattcatcctggagccccaggtatgaagtacgcagatatatccaatccttgctccaagatgcttcggatccgcagacagttcttccattgtttgatgtgctgcatggtacaaagcatcataaaggagtttctgatttgaataaatcagggaatataattcttcaggaactgtaaaaaccgtatgaaagtatggaacatccagtacattttcctgctgtttgtcaatccattcatcgacctccattccttgacacatggggcagtgacggttcttgcatgaattataatgaatatatttcttgtgacagttttcgcattcgcttaaactggctcccatttcaagagtatggcatttggagatacacagtgccgttagctgctgttggggagaaaagttgtgtgtctcacagtattgcggaagaaatcgatggaatacatcctgaatggtgatgtcatgattcatttgcatcacctgcgtttctcttagatttatgtcctcgttttttcttgacaggatgatcaagcggactctttattcccataacagttttattggatatgtggatgtatacctgtgttgattccagacagcggtgtccaagcattgcctgtacatagttgatagggacaccttgctcaatcatgtgacttgcaaaggaatggcgaagcgtatgcggatgtgcttcaatgcccgctgtttttcctactgccctgagtatgatttcaacaccactcacttttagtggttcatgaggagcatctaaagaaacaaaaagatactctctttttaccggataacttctccagtattcttttagtaaatcaagggctctttctgaaagaatcgtccatctgtcacgatgattcttccctttggaaatatatacctgcatagtgctcatatagatatcttcaggtttaagagagacaagttctcctacacgcattccagatgaataaagcagggcaatgattgctttgttacggatctgggttgcagaattgattaacttttcaatttcttcaagagaaagcactttcggaagctttacatccaatcgcattcttggaacaatgtcttgatcccatggaatgtgtaagacatgtttgtatagaaagcaaatggaagaattataaaagttgcaggttgcagatgaaagaccggaattacgtttttccagtataaataatctggcatcctgaagggataaatcttccattggtttatagcctgtccacttcataaagtgacgtatgttgttgatataggtatctgcagtccgggaggacctgttacgaatcaggcattcctctctgagtttgttaaaatatttttcgtacataataaacctccatgatactagtaacgttaatgagtcactgccatcatggaggtccacgtatcaaagataccctcttgagaaaaagagattctggtgttattctattcatggcagtgttaatgatgatcctgttcgattgttattttgtggtgatttaacaatactacttttagggctcattatctactgcctttttaagttaaagagaaaactgcgccacagccttcgcaggccatcgcgcagcgatttagttcaaaaggagtttgtggagaaagtaagtgtagatcagattactaatgttccgattaattccgatgttttcccagaggaatatgataaagatggtgatggaaaagtatatattgtcgatcagggagaatccgttaaatatttagatgaacaagaatatcttgaatggaaaaaacagattttctggatgccggagatgaaaatagaaagctgtgaattaggagaaattttaaaatgaacatggcaatgactttgttatcggcttgtgcagacaataatttaggaacagacacagagagagaatcagtcattccagaacaaaatcagaaagaagatacaaatttatataaaaatgagttaatggaaaagacgacattgtaattggagcgatatatgaaacaggagctggaccgcagggaatgattccatatattcaaattcgcatttatgaagatataggaagcgaatttgtatatgatcaggaactttgcgatgcgattaatgttgaacttccagaggacgctacagcggaacaggtaaaggaaatgataaattaaaacatacggtagattttataatttataaatctaccgtatgtttttagacgaatttgtaaaaaatgttaagcctctgcgtatttatgcaaggaaataatagccacaaaaagtaatttatggagaaacacgaatgagatggtcaaatgaaatgttctatattcttctgcttaattcattcgcaggtgcgattgtttatggattttggataatagcaaaaaacggtatggcaaagaagaaaaaattgaaatatgtgtatccaatgctcggaattgtggaagcttttttcatttttccggtaatgtttgtttatctgaaagtatctacgcatgttccgggaagccatggatcatattatggagctttatttttgcgtacaccgttcatttatacagtacagtgcgtgatagcagggatatggattctcggcgtgatatttaatttaggaaactatatcaaagaatattggaaatttaaaagtattttgaaaaaagctttgcatatgagctgcctgcagatgtatgcagtaaaattttgcaggaacttgaaatgaaaaggaaggtcacattgtaccagaactatgctgtgacttctccaattgttgttggctggtggaataagaaaattattttcccggtacaggactatgaggaaagagaacttgtaaccatactttatcatgagttagtgcatatcagacagcatattttggaaatgaaaaaaatagggattttcttaaaattgattttctggtgtaatccgatgatgaacagtctgttacgaaatattgatgagtggggagaaattgcctgcgacagatatgtgtgttatgaaactgcctatccgtacacggtaaaggaatattataccgttgctgtggatggactggaacagtcacatatctggatgccacaaatggtaactggatttaagaaaaagagtaattttaaaaggagattattgcaaatgaaaaattacagaaaagaaaaggaaatgaaatttgttggaggtgttgctttaagccttgtgctgtgcgttttgtcaacaacaacaacttttgcagcagcagaaggatttaaggctggatatgagaaggtttttgatgatacaacggtagaaatcgaggagaaagttgtggaagatgttgagtatgaagaagatttttttcctgaaaatgaaaatataaaattttataatcagaatggcattaatcttattggtggaagtggagcaatagatagtacctcattagagaaaggtacgatgcttagtataggaactgtttatgcagaaaagaatcaagggattggtataagattaaatattacaccgtcagataaaagtgttcaatacggaataattacatcagataacaaaaagagatttgtttatggtacaggatcatgctatcatgttttttcaattagtgatagtggtaactatgaaatctttattaaaaatactagttcaaaaacggttactattgaaggtggatattcagtttattaaaacaacttgttgcgaaaagttttaaatgtttcttcttaatattttgaaaggagatgatgcatttggaacaggcattaattgaagctgcaaccacgcagggaatctgggttcttctttttgtttcgctatttttgtatacaattaaaaataatgaaaaattagtggaaaagcaggataaaagagaagaaaattaccagaaactgttgtctgatatgacagaaaaatacgcagttgttgaagatatcagaaacagcgtggatgaaattcagaaaaaagtcgaaatgctttcgacagaacaaaaagtataggaaaaagattgttctatatggaatcaaatcacttattatctgatggataggtaataagtgatttggattttaaggaatgaggaaggaagaggatttatccaaatcaatggatgggtttgtgaaatgaataggatacagcacaaaaaatggatagatacattgggaatagggctgtttatattaactatgttatatatgtgcggtttgacatccaataaagacgaaatagagattgaacaaaatgtagtaacagaggataaaattcaacaagaagcagataatgaattgccagccgattttccgaaagatttattttttaacagtggagttggtggttggcggacgtatttacgattaaacagagatggctcatttacaggagagtattcagattttaacgcatatgcagaggacgatttccccaaaggaacggtaacgatatgtgaatttgaaggtaagtttacgaatattcagcggatggatcagtatcattatacaatgtctttagaaaaattagagatattggatattccggagatgtggatagaaaatggatacagatttctaaaagaagatgagccatatggtttggaaaatggtgagaattttactttatatatgccagaaacgccaatagagcagttgtcggaagactttctgacatggtggccatcgtggtattattcggaaaatgaacttgtcagaccagatgaactttcctgttatgggctatgcaatgaggcaatgcaatacggatttttttcttatgaaggaatggacgcatttgagccatatataagcagatagcacagaacgccagaaccgacatttgccggaactggcgcttttttatctatggacttattttacagtccttttatgagacttttatacacattttgttgtctaatatatgtaagataaaaaaagaagaaaagcgactgtcttacattcactgcgcgcgtggagaaaagcattatgaaaaaacaaacagatgatcttgtgaaaagagcgaaaaggcatgagtcggaagctttcacagaattaatgcagctttatatgacggatatgtataaagttgcgtatgcaattttgatgaatgatgaagatgttgccgatgcaatcggagatacgattctgatatgctgggaaaaaatgaatcaattagtgaagatacggtattttaaaacatggatgacaagaatcctcatcaacaaatgctatgatatcagaaagaaaaatcagaatatcatttgtttggatgagtacgaggaaccagcagcctgcgatgaatataatctggaattaaaagaggcactcgcagcgttagatgaaaaataccggattattatgattcttttttacagcgagggctatcgtatcagagaaatttctgacattttaaaaattcctgaaagtactgtgaaaacacgtttacaacgtggacgggaaaagctggaagtttattataaggaaaaatgaggtgagattcatgtcaaaaaaagtgagtgaaattttaaatagtgatattcaagtgccagaaatcgttcagaaaaaagcagatgtcgccttttcacagattcaatcggaaagggaaactaatatgagtaagaaaaatttaaaagtaacaaaattgtttgcagcaatggctgcctgtgcatcgattatcattgttgcatccacaacaaacaactatctcaacagaccgcaggaagaaaaagaaacaacagtggctgaacatacaacaacagaaaaagagaatatgtttaccatgaaagtaatggcggcacaggcagaagtgacggcacagaagcctgtagcaatcgcacaaaatgacaggtttggttatgcgattaatggggacagcgatatgaatacagcaagttataaaattgatatgccactttactgcgaaggtgagaatatagaaagtgtaacttacagtatcaacaaaggatattttgaaataagtgaaaatattaccgatgattttcagagtgctgtcgagagcggaaagccattggatgaaaatagcaatgggtatctcaatccaatttttgatgataatggagaaattgccatgcagcaggaagtaaacgattttgttgaatacacagtttcctatgaaaatcagcagaaagaaggagtgtgggtaaccttttgtaatgatgaaattccgttttcagattttgacagtattgtagaacaaaagaaaaaaacacaggaggaagtggcagccgcatatcaaaaacttgtagatggagtggttattacctgtactgcaaattataaagacggcacaaaaaaaggagtaaaaattaatgttggagctgcagcgctgacttatgaagaaatcggaatgaacgtggacggaatgactttacaagtagaaggagaagataaagtagaacttcagccaacagataaaagagcagtttttacgtttgaattgcagccatgacagataaaatcagtattattttttaacagtggagctggtggctggcggacgtatttgagattaaacagtattgaaaaagatatatatttattttataataaataaaactaaaaaaataatttcaatattataaatgaggcatgaatatgaaaaaaggtattagaagatatttcataatcttgattgtaataatagtatgtattgtgacattggtggactgcaccaatactcagacgagacgggaagaaagaacatctgccagtcatttgattataaattgggagaatgaagttcagatttttgatgcagatgcaatggaaaatactggaatggttgaaaatatagagacgcttgcctggattgcaccacgaggcggagccgggattgacacagtgggtattgaacaaatacagtcacagaatgaatacattgtagaaagcagtcagtatctgaatcaggataaagaaatcattaataccgaaggatttgatacatgggtaagggttgtacaggagcaggtgatgcccaaaaaagaaacatcagagacaggacatggagactatctgatctataagcacggagataatggatatctggcaatacagtctggcgaagatcgcacaaagtggacagtatgggaattaccgggttatggggagtggctggataaggaagtagcaatgtttataagaatggtaactggattgtaaaaaattaaaaaagagtttacaaaaatcaataaattttcttcttaattattagaataatattggataagaaagaagaacatagaaaatgcttcttatgcgttgaaaaacaaagcagattctattatgataaatggggaacatgattgatactatggtaaacttgcaataattttatacaagcaatataatattgataatgaatttaactaataatagtatagctgagtaatataaaattattaaggtggaagaataggaagtaatatgagactaattttagaaaatgttggaaaagtgcaagaagcagatattaagttagatggaataacgttaattgctggagaaaacaacacaggaaaaagcacagtagggaaaatgttattctgcatttttgaatctttttataaaatagaaaggcagataagtcaagaacggattaatacaataggacgtcatattgccaatttttatcatgaaacctttaatcgtgcaggaagaaagtattctgtacatgatctcgcagcggaatttgtgcacaataaggagcagtatgttggagattccagaatcattagaaaagcaattgaaaatttttttgaaaatcgagaaataaattttgatgcaattgcatatcaggatacattagagcaattagcagacaaaatatattctgtcctatttattgaagatacagaaatacgcagggcaattttgcaaagaacattggactctgaatttggaatgaaaataggatttttaaataatgagagtaattattcaaaaattcagctggaaataagaaatagcaagatcgaatttgaagtgatcaataatgaaaacataaatattatacaggatatgagtttgaataaggagattatctatatagatgatccatttgtattggatgatttacaagatttattgccatatcggagagtttatggtttgaatcatagagacagtttactggataagattgtaagggttaaggatacaagagattttggtgctctggatgaaatcttggtaaataaaaaacttgagcgaatttttgaaacaatgaatggtatatgtgatggagatttaactgtatcggaagatggaggaaattatagttataggacaagtgaactgaatggtacacttgaaatgtctaatttatcaactggaataaaaagttttattattttaaaaacactattaagaaatggaagtattaatgataatggtgtagtaatattagatgaaccagagatacacttacatcctgagtggcaattaaagtttgcagaagttatcgtattgattcagaaagaatttggtgtaaatattttgttaaatacacatagtccttattttttaaatgcaatcgaggtatatgtaaaaaaatatgggattgaaaagaaatgtaaattttatctgacagatgacaatgagggaagaaccaatattaaggatgtaacagatcagacagaactgatatatgaaaagttggctagaccattacaggatttggagaatttggagtatagcgatggaaacacgatatgataaatttgaattttttaagaatagtttatcttcattaaaagagacatctaaagattcagacagcaaagagatcagttatatgacagaatcagatttgcaagtggtaaattttgataaagtaaaagaaaaatatgcaaaaaaattaggagtatcagagacaccatgttcgaatgatgctctttatttatcagaagcaggcaattactattttattgagtttaaaaatggaaaaatacagagtaatgtaatttataatgtatacaataaaatatatgatagtttgttgatatttacagatatagtagatgagagggtttcattttgtagaaataatgtaaattttattttagtttataatgaagaaaagaatcccaataacactgacgtaaaagaggataaatctcgagtagcaattggaaagcattttatgaaaaagggtggaaagagatttgtgcgtttcaaccttgaaaagtttgaaaagttatattttcatgctgtatatacatatacagaatccgaatttgaacaggaatttgtacaaaaatatagtataaatgattagtgtctgctgaacaataaggtattaacgcaccggattatgacgtgcagaaaatatatcaattacttttgaaaaaaaacacacaggacagcttaacataggagctgtcctgtgtgtttttcagatcttagatgaaaaacctaagaatattaatactttttttaatatttctatgaaatcttccaataagagagtgaaacagtttttctctccacattgcggtgattttatgcctgtgccggaggagtctttcttcatctgagcggtatcaggtaaagaactgttgccggatacattggcagatccggttgtagaagcagtttcggaaaccaaaccagccacagtatctgtagatgaaccatcagtgtttgtattacctgatgccggtggtacaggtgtggatgctggtggcaccggggcaggatctgaaattacagaaaaatccgccgttgccgttccggttgttgatacaatggcaatgctgtgagttccttcggaaagaccggcaaggaaggatggaagtaaagttatgatagtacttccggagctggcagtatagtctttatctttcgttaatttaataccatttacctctactcgaactaattcgttgagcggtgcactggaacgaaatactgcaccggagttattgtctggatttttgctcacttctgctttgtcaccttccagcatgaccggtggattaccaggagacacaggcggtatttccggttccggttttccatcaggtggagtgactggtaatttatcaatgatctcaccagcttctactatggcgttacaatctgtacataccagatcaccggtatatccggtttcctcctgtgttggctctttaaagccccgtcgctggagattcaaatggcatgttggatctatttctccgtattcctccctacatttttcacagacggcttttttcatacaggtcgcctgtccaccggaatggacatgttgttccatttccccttcgatttgaaaggtaaggacttccccttctatagcagcgacagtcaccttgagtttgtctgtaacctgaagcgaatcatttaagccaagggctgcatcagatttagtggattgtgtaccgcccataacttccagtgcccaatttcccggttttccatttagattgcttggaaagcggatgtcaggttgcgcaagataacagactaaaccggattttatgtttgatgtttctgaattggtcagctgcttctctgacttatcatatttactgccatctgttgaaaagtttctgtattccagatacagtgtcctgttcagttccggaatgcctgctttatatccgatacagtcgtcagtaccggtggctgtgccgctgagctttactttgtatttacccggttctgtgatcgtctttagagtactagggtctgtccatcccagagcctctttttctttgatcgaaagtccctgtggaacaggtgagatggcatttgccatggcagacatgaaataaaccggtgtttgacctgacgaattgtataaatccagcagaccaaatatatgccccatttcatggattggagacttcaaggaaacgatcggttttcgatcttcgtttgccatatacagagtcgagtagttatttatgacctgtacataatattggctttgaagcatcctgccatcggcaagagtgatctccacatagtcagcataatccttatagttccaaagcggatcagagcggtttatcacaatattttgtgtcgtgtttttatagataacagtaatggaatcaatctttccgtcacggtttttatccagatcctcgtaactgtatgtctggctgccatcgtaattcgtaatgtggtttccgttctggatagctttgtttatggcatcagaccaatcggtgcgcagctcgtacatgcggtaggctttttcaccacttgttttataaccgattggattatctgcactgtaaccggcatagtaaccgcgttcatgtttcaactgcagggaaccgccgttatcaaacagataaagactattcatgcgcaatttgtctgaggacgcattccggtagtaatcgcccacggaataataggcagtgttataggaattgtctatgatttcccttacagagacaccttgataaatatcattcacaaattcattctcatctgcaaatctggcaaatacgattaaatttgtaaagtttggatcagaagtctgttctgtattcccgacagctgcgccctttacggacagagagccaaaaccgacattcagcagcagacacatggatatcagcaatccgaaaaatgtacatatttttttcatacatagtctcctttttgtcgttgaatgttgcataggtttttatagtttctggaaaaaaggcgtagagccgttttttatttcttaaaattcgctctttttcttaaagtcggatccaaaattctcttacggatacgaagggatttcggagtaacctccaataattcatcgacatcgatgaagtcaagcgcctgctctaagcttaaaatcttaggcggaactaaagtcaatgcttcgtcagcggaagaggaacgtgtattggtaaggtgtttcttcttacaaacattcaattcgatatcctcgtttctggagcaggaaccgatgaccatacctgcatatactttttcaccaggtccgatgaacaaagtaccacggtcctgtgcagagaacagaccgtaagtgacagattcgccggattcgaatgcaatcagcgaaccaagctgacggtaagcaatatctccgcggtaagtatcatagccattgaaaatggtgttgataataccattacctctggtatcggtcataaattcgcctctgtaaccgatcagaccgcgggatgggatattgaactcaagtcttgtatatccgccggtcagaggtttcatattgatcatttcacctttgcgctggcttaacttgtcgataacagcaccggtatactcatccggaacatcgacataggcaagttccataggctctaatttcttgccgttttcgtccgtgtgatataatacttcagccttacttacggcaaactcatatccctcacgacgcatattttcaatcaatacagataaatgtaattcgccgcggcccgatactttgtagctgtccggggaatcggtctcttctacacgaagggaaacgtctgtatttaactcgcggaataaacggtctcttaagtggcgggaagtaataaactttccttcctgacctgccaatggactgtcatttacgatgaagttcatggaaagagtcggctcggagatcttctggaatgggatcgcaaccgggttctccacagaacagatcgtatcaccaatgtgaatatcagcaataccggaaatagcaacgatggaaccaatatttgcttcttcgacatctaccttatttaatccgtcaaattcgtataatttgctgatgcggacttttttcttcttgtcaggatcgtgatggttgactacgaccgcttcctgatttactttcagggaaccattgtcgatcttaccgataccgatacgtccaacgtattcattgtaatcaatggtactgatcagtacctgtgtcggtgcttcaggatcaccttccggagcaggaatgtaatctaaaatggtttcaaataatggtgtcatatcttttttgttgtttacaaggtcgtggatttcacgaacggcataaccgtctcttgcggaagcaaaaaggaatgggcagtctaactgctcgtcagaggcatccagatccataaataactctaatacttcgtccacaacttcgtttggacgggcttccgggcggtctactttattgacacagacgataaccgggagttttaaatccagagctttcatcaaaacgaatttggtctgaggcataacaccttcaaatgcgtcaacgacaaggataacaccgtttaccattttaaggacacgctctacctcgccaccgaaatcggcgtggccaggagtgtcgatgatgtttatctttgttcctttgtaagtgatcgctgtatttttggagaggattgtgataccacgttccttctcaatatcgttggagtccatgacacgttcagcaacttcctgattctcacggaatacaccactctgttttaaaagttcatcgaccagtgttgttttgccatggtcaacgtgggcgatgattgctatgttacgtacgtcttcacgtttctgtttcataaaaaatctctctttcttctgtgcggaaaagaaattatctagaaataaatcctgtcttttcctattaatatagcttataaattaactcgaacccatatattctatcacaattttatgagaacgcaagtaggcagcaatattttttttcaaaacaatataaaaaacttatcgacaagttacacgaaattttttctggaaggaaatggtaaaaccatagttgtcaggcaaatcaccggtcgattccggtgataagaggaagggagaaaaaattcatggcagataaaatttttgaaaataaccaggtgtcaattgtgggagagattgtttctgatttcagattcagccacgaagtgtatggagagggcttttatgtggtagatgtcgcagtcaaccggctgagcaattttatggattacataccactgatgatctcagaacggctcattgacgtgaatgaggactatattggtcagaccatatatgttatgggacagttccggtcattcaaccggcacgaggaaaaaaagaaccgtcttgttttatccgtttttgtaagggaactggaattgttagatgagatcgatgaggatatcaagacgaaccagatttttctggatggctacatctgtaaagatccgatttaccggaaaacaccgcttggaagagagattgcagaccttttgatcgcggtgaaccgttcttatggaaaatcagattatattccatgcatctgctggggaagaaatgcaaggtttgcatccgggtttgaagtcggagggcatgttcaggtatggggacgtatccagagcagggagtatgtgaaaaaactgagcgagacagagacagaaaagcgcgtggcatatgaggtttctgtgagcaaagtggaatttatcgaagacgaagagtagatgttaacagggaaattattcctgagagtagatattgacagggaaatcgtgcattgacaatggaataagatggtgttatgatttacgcaatgaaaatattgcttggtagaggtcgcgtgctttatgagtcgctttttggatgtatcaggaacagttgataagaagcaaaaggaaagtacgccgaaagggtatgcagcctgaaggcatattacttgggcataaagtgaagaactttatgactgtcatctgaatggagatcatttgagatggggagctatcagattctaggcagatttgcaaagatgcagaatgcgtataatattagaattttgagaccggctcgtcagccggtctttttttactttactgtagcaacatttttaacaaaaaaaaatgcagtgcgtataatgacgataggaggagaatgcaatgtctatttttaaaggagcaggtgtagcgatcgtcacaccgatgaaagaaaacgaagaagtcaattacgaaaagttacaggaactgatcgaatggcagatcgaccagggaacagatgcgatcatcattgcaggaacgacaggagagagttccacactgaccatggaagagcacagtaaagtgatcaaagcagcagtagaatttgcaaaacaccgtgtaccggttgtggctggttccggttcgaactgcacaagagaagctatttatctgacacaggaagcagaggaagcaggagcggacggaatccttgcagtgacaccttattataataaatgtacacagggcggtctggtacgttattattctgaaattgcagagtgtacaaagttaccgatcatcatgtataatgtacctggaagaaccggatgcaatattcttccggagacagcagcaaagatttttaaggaagttgaaaatgtagtagcaatcaaagaggcgacaggaagtgttgcacaggcatcacagttaatgtatctgaccgatggcaggatcgacctttattccggcgaggatggaatcgtagttccgcttatggcgatcggcgcaatcggagtgatctctgtatggtcaaatgttgcacctgccaaagtacatggcatgtgccagagtttctttgatggagacttacagactgcaatgaagatacagagagaggcacagccgcttgtcagtgcattattctcagaggtcaacccgattccggtgaagaaagctttaaacctcatgggaagagaagttggaacacttcgttctcctttgacggagatgaccgatgcaaatgcagctgttttggcagatgcaatgaaagcatatggcattttagattaaaaggaagagactgtcgtatccgggtgcggcagtctttttggatttattgataaattatatccaaagataaaattcgaaaggtggatttttaagtatgacaaaagtaattatgcatggatgcaatggaaaaatgggacagacgatcacggcgatgtgcaaggatgatccggaaattgagatcgtggcaggcatagatctgtatgacgggatcaaaaatgattatccggtatttccgaatatctccgtctgcgacgtgaaggcagatgcagtgattgatttctcaaatgcaaaggcagtggatgatctgctcatctactgtgaggaaaaacaggtgccggttgtattgtgcacgaccggtttgtccgaggaacaactcgcaaaagtaaaacaggtcagcggacatgtggcagttttaaaatcagccaatatgtcactcggcatcaatatgctgatggaacttttgaaaaaggcggctttaacgctcgcaccggcaggtttcgatatggagatcgtggagaaacaccacaatcagaaattggatgcaccgagcggaacggctctcgctctggcagactccatgaatgaggcgctgaatgagaagtatgcctatgtttatgacagaagccgggagagaaagaagagagaaaaatacgagatcggaatttccgcagtgcgcggtggaaatatcgtgggagagcatgaagtgatctttgcaggacaggacgaagtgatcgaatttaagcacacggcatattccaaggcagtttttgccaagggagcagtgcaggcggcaaaatttcttgcaggaaagccggcaggattttatgatatgagcgatgtcattcaggcgcaatgatgaatgaagtataaatcagtacacagaataaaaacaggatggtgacggatggaacagaccgatttacgttatttaaaaagtcttgcaaagcagtatccgaccgtggcggcggccgccacagagattatcaatttacaggcgattttaagcctgccgaagggaacggaacattttatcacggatatccatggcgaatatgatcagtttcaacatgtattaaagaacggttccggagcgatcaagagaaagatcgaggacgagtttgggaatgccatcagtcaggcagaaaagaaatcgatcgctacactgatctattacccggaacagaagatggagcaggtgataaagaccgaggagaacatggaggactggtacaaggtcacattgtaccgcctgatcaggatctgcaaaggagcgtcttctaagtacacccgttccaaggtgcgcaaggcgcttccgaaagattttgcctatgtgatcgaggaacttctgaccggaagaccggatgtatccgatcaggaggcatattataatgaaatcatccattcggtgatccggacaggcagggcagcagaacttgtggtggcattctgcaaccttatccgcagacttgtagtggatcatctgcatgttgtcggcgatatttttgacagaggaccgtatccaaaccttattatggatacattaatgtcacatcattccgtggatatccagtggggaaaccatgatatctcgtggatgggtgcagcagcgggcaatcaggcgctgatctgcaacgtgatccgcatctccgcaaaatacggcaatctgaatctgctggaggatggatatgggatcaatctggtgccgcttgcgagactggcaatgaaccgttatgacaaagatccttgcagctgttttaaactggattaccgggaagaggaatatgatgtccgggatgcaatgctcgatgagaaaatgcacaaggcgatcgccatcatgcagtttaagctggaaggacagatgatcgtgggacacccggaatttggaatggagaaccgtttgctgctcgataagatagaccccgcagccggtacagtcctgatcgaagggaagaaatatccgctccgggatctgaattttccaaccattgactgggaacatccgtatgaactttcggcggatgaggcagatgtgatggaacgtctgactgccgcatttttaaattgtgagaaattacagagacaggtgcgttttctttttaccaagggaagcctgtatcatgtatacaatggaaatcttctgtatcacggctgcgttccgctgaatgaggatggctcttttaccaaagtcaatatttacggcacggaatatgccggaaaagcgttgtacgatgtgttagaaagctacgccagaaaaggttattacgccattgacccggaagagaagaaaaagggatcagacattctctggtttatctgggaaaataaaaattcaccggtatttggcaaagataagatgacaacgttcgagcggtattttgtggcagagaaagcgacacatgtggaaccgaaaaatccgtattaccggctgctggaaaaagaagaggtcgtaaatgcgatcctcgcagagttcggactgtccggccaggaggcgcatattgtcaatggacatatcccgatcgaggcaaaaaagggagagtccccggtgaagtgcgggggcaagcttctcatcatagatggcggcttttccaaggcttatcagccaaagaccggaattgccgggtacacattgatctacaattcatatggacttgtgctggcggcgcatgagccttttgaatccgtggaaaaggcagtttcggatggaaatgatattgtatcacatacgattctggtgcagcatgttgtgagacggaaaacggttgcagacacagataatggaaaagtgatgcgggaaaatatccgtgatcttgaaaatttacttcaggcatatcgtgaaggaacgattgtagaaaatccttaaaagtgttatactacatttatcttaccataatttaccagagtaacgtatggtctggaataatatgataccaaagaagggagtttcttatgaaaaagaaagtaatacagattttatccattgcattgtgcatggtgctgctgtccggaagcactgtcacggcaaatgcagcaaagaaatcatcgaatacaggtgcatatcaggcagtatttgatgcagaatattattataattccaacccggatcttcaggcggcgtttggatatgatgcacagaagttgttcaatcattttgtatcttccggcatttatgagggaagatcaggctgcgctaatttcaatgttgcaatttacagagccaattacccggatcttcaggcagcattcggcaatgaccttgcatcctactgtgcccattatgcggcaaacggtgcagcagagggaagaaatgcaacaacactgatctcggcaggggagggagcacaggcagcgattgtccgtggttcctgcacaacgaagtttgatccgagagcttccagagcaaccaacattgcagtggcagcttccagaatcaacggtgtagtcattcagccaggggaagagttttcctttaacagaacgatcctgccaagaacggcagcaaacggttatgtggaagcgccaatttatgtgagtggtaaacattccacaggaacaggcggaggtatctgtcaggtatcttctaccatgtattctgcaatgttaaacggaggaatcccggcgactgagcgtcacccacattctctcccggttccatatcttccagaaggcagagatgcgacaattgcaggtaattattacgacttaagatttgtgaatatttataatacgccattgcagatttcagcagtagcagatttaagaaccggtacagtcagtgtgactttgatccagcagtaattgttaagaaaaataagaaaagtaaaatacgaaacttaagtttattaggtttcgtattttgttttcacggaaaagggggattacgatgaacggaaaaaaagttatgttaacaatccagggggagaaaaaagagtatccggcaggaacaagttttttgcgcattgcgcaggattacagcgatgcgtatcaggatgatattgttctggtattgtacaataggagactgcgggaattaaataagtgtgcagatggagacggaaccgtagaatttctcacaaccgcagacaagacagggaaaaaggcgtaccgcagaagcgtgacacttttaatgcagaaggcagtctataatctctggggaaaagggaatatatcggtgcgtgtaaaatactccatcggacagggaaattattgtgaacttgtgaagtgggagaatgatacagaggaagttgtgaaagtatcaggaacagaaatcaataaattaaagaatgagatgtatcagatggtagtttccgatattgagatccacaaggagagtatcaatacggatgacgccgtgacactgtttcatgaccttggaatgacagacaaggaaaagctgttccgttaccggagaagttccagagtcaatatttatgaactcgatcattacatggattatttttacggatttatggtgccatcgaccggatatctgcgctattatgatgtgatcccttatgcggatggatttatgcttcagttcccggataaaaatacgagagaggtcgcaccgtttgttccggcagaaaaactgttccacacgttaaagacatccagagactggggaaaaatgcttgagatcgatacgatcggagccttaaatgatgcgatcgcagccggaaaaacacagcagatgatactgacgcaggaagccttgtttgaggagcgtatcggaaggcttgccgaggagatcatttcagcaaaagaccggaaattcattatgatcgcaggaccatcctcctcaggaaaaacgactttttcacacagactgtccattcagctggctgcaaaaggactgaatccgcatccatttccactggatgattattataagaaccgtgacatctgtccaagggatgagaacggcgaactggatcttgaatgtctggatgcgctggatgtggaattattcaaccatgacatgaatgaactgctggcaggaaaaacagtcaatcttcctatttttaacttcaagacgggaaaaagggaatacaaagataagcttatgacactgggaaaggatgatgtgttagtcatcgagggaatccatggtctgaatgacaagttgtcctattccctgccgattgagagcaagtttaagatttatatcagtgcgctgacgcagttgaatattgatgaacataactgtctgccgacgactgacggaagactgatccggcggattgtccgcgatgcacggacacgcgggacctctgcaaaagaaaccatcgccatgtgggattccgtgcgcagaggagaagaaaaatacatttttccatttcaggaaggtgcggatgtgatgtttaactcagcgctcatctacgagctggcggttcttaaaatgtatgcggaaccattgctttttgctattgacaaagactgcccggaatatttagaggcaaagcgtctgctgaaattcctggactatttccttccaatgccgagcgatggaatcaaccagaattccattctgcgtgaatttatcggcggaagctgttttaatgtataaaagcagtggaaattttggcgaaaaaaattttcttgcgaaaaaattttcttgcgaaaattaaaggaatagtgtatattaaggagcgtcgcaaagtttttgcggcgttctttcagtttttaaaataagtaggacaaatgatcgcggctgcaagtgtcgaaagaccgcaggtgaggaaagtccgggcttcacagggcagaatgccggataacgtccggtggaggcgactccaaggaaagtgcaacagaaatataccgccgattctggcttgaccagaatctggtaagggtggaagggcagtgtaagagactaccgcctttctggtaacaggaggggcatatgtaaaccccattcgaagcaagaccgaacaaaagcgttgacgtggcccgccagctttaggtaggtcgcttgaaatggctggcaacagtcattctagaaagatgatcattcgtgtctgcatttgcagacggacataacccggcttatcgtcctgcttattttagatagagaagatgtcagctgacatctttttttttatgccggattgttgtatgatggtgtaagtgtagaaattatcattgcgcctgcaaaaagtgcaccgcaatgtgtatacaaaaaaatcgtggcaatcatatatagaagaaagttgaggacgatcatgcagagtgatactaccggatctttacaggaatttcataagatattagaagaggcaggaaaaaaaggagcttccgatatccattatgtgccgaaagagcagctgctgctccggatagatggaaggcttgtggatatgacagaggaatggaacgtgtctttttccatggaggaactcatagagaaattgctggacaaaaaacagcagaaaacattcgaagaaaatggagaggttgaattttcctgcccggttttcaataagcgtgtccgcgtgaatctgttccggcagagtggaacgtgtgcaatgtctgtccgtctgttcgcagagaagatcccgacaccgcagatgcttggacttccggagtcggcagtgcagatggctgggaagagaagaggactcattcttgtgacaggtgcatccggaagtggaaggacaacaacgatggcatcgatgatcgaccatattgcttctaattatgagcggtcgatcctgacactggaaaaaccggcagagtatcttttccggagcggaaagtccatggtgctgcagcgggagatcggcattgacagccggtcttatgaagcaggattaaaagctgcgttaaaacaggatatggatgtcattctgatcagtgagatggaagatctggatacggtttcacttgcgctgactgcggcggagatgggacatcttgtgattgccgcacttccgacccaaaatgcggtggcttccatcgaacggatcgtggaatgtttcccggatcacaggcagcatcagatccgttcacagctttcggatgtactggcaggcgttatttcccagcagcttcttccgagactggatggaggcggacgtgtggcggcgtttgaagttcttttggcaaatcaggagataaaaagcctgataaaggaacagaagtatttccagataccgtccgtgatgcgcagctgcagaaaagagggaatggtctccatggacgatgccgtgtacgacctttatatgaagagtatgatcgactcggatactgctgtctgctatgcacaggatggtgtgggcatgcgtcagaaagtacagttattttaaattattatagaaatctaaaatgtttcttaaaagacaataggtgtgttgacgcgatttcctttgaagcgtaacataaaatcacttgataggaggtcggaacaatgagggagaaaatacagcgttttatgattggaagatatggggcggatgaattggcaaaagcacagagcattgctgcactggtattgctttttttgtcgatgttcagccgtcttggcattttttactggctggcgatcgcgctgatgatctattccacatggagaatgttctcgaagaatatttccgcaagatatgcagaaaatcagaaatatctcaactacagatatcagatggctgtgaagtgggaccggtttaaaaagcatctggcacagagaaaaaactacagattttacaaatgtccgcaatgtaaacagaaagtgagagtgccaaaaggcagaggaaaaatctgcatcacctgtccaaaatgccggacagaatttgtgaaaaaaagttgaaaataaaaggagatttttccattgtttggttatatcaatatcaatcaaaaagaactatcggaagaaagtaaaaaaatatatcaggcatattactgcggactctgccagaaactcaaaacaaactgtggcacaaaagggcagatgctgttaagttatgatctgacatttctgatcgttctgctgaccgggctgtatgaactggagaacaccgacacagagtttacctgtccgctgcacccgacgaagaaacggacggcttacatcaatgaggcgacagagtatgctgcagacatgaacctgatcctggcataccagaatcttttagatgactggaaggacgagaaatcctacacgaaaaaagcatttgtaaaaatcctcgataaggattatactcgtatcgtgtcaaaatatccaagacaggtaagggcattggaagaattcatgcgtaagacagcggaagcagagaagaataaagagacgaatctcgatcttgtggcaggtcttaccggtgagatgcttggagagatcatgtgctggcgggaggatgagtggcaggaggagatgcgtactcttggattttatatgggtaagtttatttatctgatggacgcatacgaagactatgaagcagaccagaagaagaactgctataatccgcttgtatacatggaaaaagaaaatgatcaggaatttgatacattctgtaaattgctgctgacgagcatgatgtcggaatgtgccaagtcattcgagcgtctgccgattttactgcatgcggatattttgcggaatattctctactccggtgtatggagcagatatgaatacttacagcttagaaaaaagaaactggaagagaaaaagacgaagagaaaaaaagaagacaggaaaaagtaacaggagaattatatgatgaatccatatcaggtgctcggtatttcaccgggtgcctcggatgatgagataaaaaaagcatatcgggctttaagccgtaaatatcacccggatgctaatattaacaatccgaataaggcacaggctgaggagaagtttaaggaagtacagcaggcctatgaccagatcatgaaggaaaaacagtcgggcggaagctttggtggaagttatggatataacacctcctccgcaggtggtggaagctatcggtacaattacagtggaaatcagggatacagaacagcgaatgactccccacagatgcaggcggctgcaaattatatcgcaaaccgctgttatgcggaagcactcaatgttttgaacggtattccatttgcagagcgcagcgcacgatggtactactatagtgcaatggcaaatcagggagccggcaataatatcgttgcaaaacagcatgcgggaagggctgtcgagatggagccaagtaattttgaataccgtcagtttttacaacatctggaatttggaggtacatggtacaccagcatgggtgataattatgacagaccatattccagttccggaagctggtgcttaagcctcctgtttttgaatatgctgtgcaactgctgttgtctgcggccattctgagaatcattttttacaaagattatgaaatatgcgatataaaaaagtccccttgaatggggacttttttgtgccgtatttttatctgcggtttggattggtatatttctcttcacagtatttgcagcggtaaacttcttttgcctcatcggtgagaaggaagatctggtcgagttcctgctcgatggaagtgatgcagcgtgggtttttgcaccggatgacattctttacctgttttggcatgtgaagctcctttttctctacgatcttggaatccttgatcacattgaccgtgatgttgtggtcaatgaatccgagaatatctaagtctaatgcctcaaccggacattccacttttaaaatgtcctttttgcccatcttattgctctttgcattcttaatgatggcaacggtgcagtctaactggtctaatttcagatcatgataaatctgaaggctcattcccgcctggatatggtctaagacgaaaccttcctgaataccactaatatttaacatgtgtactcctatctgtgacggacgtcacgaaaaatcttaatattcaaaatccataaaaactgattcagagtctgcatcagtggatttaaagcttcgcagtatcgatttcaagcaatgtcaggatcagtgccatccttacatagacgccgtactgcgcctgacggaagtaggcagctcttggatcatcatccacttcgacagagatctcattgacacgagggagtgggtgaagcactaacatatcgtcttttgcaagatccattttagctttggtcagaatatagaaattcttcaaacgcacgtagtcttcttcgttgaagaaacgttccttctgtacacgtgtcatatataaaatatcaagatccggcattgcatcttctaagcgttccacctcttcaaatggaatattgttggctctcaatacatcttcgcggatatagcttggaatctttaactcttccggtgagatgagtacgaacctgatccccgggtaacggatgagagcattgatcagtgaatgtacggtccgtccgaattttaagtcgccacagagaccaatcgtcatgttggacagtctgccctttaaagaccggatcgtcaataagtccgtcaatgtctgggtaggatgctgatgaccaccgtcgccggcattaattactggaatacgggatttttgggaggctacaagaggtgcaccttcctttggatgacgcatagcacagatatctgcgtaacaggaaataatccggatcgtatcagaaacactttcacctttggatgcggaagaacaactcgcatcggaaaaacctaaaacagaaccaccaagatttaacatggcagcttcaaaactaagtcttgttcgtgtacttggctcataaaaacatgttgcaagctttttgccatcacatgcatgggcatacttgccaggaaacttctcgatatcatttgcaaggtctaagagtttgtctaactcttcgacggagaagtctaatggactcattaaatgacgcatataaacctccttataaatacctgctcttttataagaaatagtgatatttctctcaggcatttttactatcatataataatcattttccaaattcaagagaaaaattatttacgttatattggtacaaaataataaaattttcagaattttttgggcggcagctggctttttatattgcagtttgaaagcaaaaaagctataatcaaataatcatgaggatgaaaagcaatccggagaaaaaaaggagtatcatatggctgaagatatcaggacaatgcatgaagaagacgaggatgaagtaaaatactgtgagcggaagagattattatttttcggtctgccatggacgtttacaaagtatacgatcacaccaagcatgctgacgatcgatcaaggtctgttaaagacggaagaaaatgactgttacatgtacaaggtacaggatgtgaagctgacaacgacactgttggagcgcattttcgggctcggaacgatcacctgctacaccggggatgtcacgaatgcggaactgaaactgatccacatcagaaagtcaaaggaagtcaaaaattatcttttgaaagcatcagaagtggcacgtatgaaacgccgcacattaaatacactagacattggagctgcgcaggatctgtcggatgctctggattcatgatctaaaacttacttagagaggattttctcaaagatcagtccggcagccatccataccggcgcatagtcaagacggatgacaccatttatgtttgtgggagcattgctgtaatcccagggacatagatggtgtttttttaacagggaaccacttaagtactcaaaacagaaaatacctgtggaatagataaagccccggaagagagcagggatttttttaaagtatctgtacagcggtttgatgatacatgccatgccgtaaatgggaaacatccagacggaagtctgcccgatcaggcgcaggtcatgccggctgcaattgccgatggaggtaaaaagaatttcaaggcaccagcccgtgagtccgcagataaaaaagtttcgccgcataataaaagtctcctgttttttttatataatatgtcacagatccattgatttcatacatggaatcgaatgggacaacttgtaaaatcagccttcttgtcatataataaaaaaagtacattctgccatcaggcaggggagcggtatgcaattattacgcagtctgttaaaacagatttcatacgaaagtgtaaggggagacgatgaccggaagataacggatatctgttgtcattctgaaaaagtaaaagaaggctccctttttgtttgcataaatggatatcggaacaacggtcatgaatatgtgccgcaggcggtggaacacggtgcagcggtactggttgtggatgaccgctatgtgatcgagagccggtctggaccggtgatcctgacagaacacatgaaggtggatgtgcacgaactgatccgtgacagaaatatctgtgtggtcacagtgagagataccagaaaagcgctttcggcgctctcggcagctttctttgatcatccggcagaacggatgaagatgatcggcatcacaggcacgaatggcaagacgacaacagcatttctgactgcggggattttgcaggaagccggttaccgggtaggaatgatcggaacgatcgaatcctatgatggaagaaggagagagacggtgaaaaacaccacgccggaatcgtgcgagatccacaggcttttgtcccgcatggtggaaaatgaatgtgactgctgtgtgatggaggtgtcctcgcagggcattgcattgcagcgcacggcagatgttttttttgatatcggcgtttttctgaacatagaaccggatcatatcggaaagggggaacatgcaactttttccgagtatctgtactgcaaaagcaggctgatgcggcagtgtggcattggcattgtgaatcaggatgatccgaatgtggataagatacttgcaggacatacctgcgaggtggagaacttctccatccggcacccttcggacgtgatggcggaggacgaatggtatgggatggaatcgggcagcttacaaagccattttacggtaaaaagagagtggcggagagaggatatcgtcatgcagcttccggggcagtttaatatctataatgcgcttgccgccatttctgtggcagggcattttaaggtggaccgggagcagataaaagcagcgctggcaaaacagatcgtgccgggaagatgtcagaacatgacggctgggaccgggtatgtgttcctgatcgattatgcccacaatgagatgagtcttcggaatctgctcgaaactttacgaaaattcaaaccggcaaggctgatcgtgatttttggatgcggaggaaaccgctctgttttgagaaggtatcagatgggagagacggcaggcagactggcagattttaccattatcacctcggataatccaaggtgggaggatccggagcggatcatggaccagatcgaggatgggctgcgtggcgcattgtgtgcaggggaaaagccatcttacataaagatcgcagaccgcagggcggcagtggaatatgccgtttcaatggcagagaaaagggatattattgttttagccggaaaaggacacgagagttatcaggagatcaaaggaatcagatatccgttagacgacagaaaaatagtacaggaggcgctggatggcggaatacgcaaatatcattgttgatatattcaatgaaaaattagataaaacatttcaatataggattccggaagcaatgaaggaaaaactgacacttggaatgcaggtgtatgtcccattcggcagacgtaatatcaagggatatgttgtggggctgacggatgaaccggagtttgaggtggcaaagatcaaagaaattatcgggatcgcgacagacagcgttccgattgaaagccagttgatcgcactggcaggctggatgaagaaaaactatggggcgaccatgaaccatgcgttaaaaaccgtcattccgatcaagaaaaaaagcaatgcagtggaacacaaaagcgtccgcctgaagctgacggagatcgaagccaaaagtgaacttgcagaatttgaacggaaacatcagaaggcgcgtgtgcggctgttgtctgcactgatcgaaaatcctcagatggatcagagcatgatcacacagaagctgaatgtttcgggtgctgtgatccgggcgttagagaccatgggaatcgtggaggtggtcagtgagcggtcttaccgcaacccggtgtcacatttagacagcaaggggtatcacctcacgttaaacgaagaacagcagtccgtggtggatgtgatcgagcggaatctggatcagaaaatcgcaaaaacttatctgatcaagggcgtgaccggaagcggcaagacggaggtgtacatggaactgattgcccatatgttagcgcagggaaaacaggcgatcgtgctgatccctgagatcgcgctgacatttcagaccgtcatgcggttttacaaccgtttcggagacagggtttccatcatgaattccagattgtctccgggagagcggtttgaccagtttgagcgggcaaaaaacggggacgtggatattatgataggcccgagatcggcgttgttcacacctttttcaaaattagggcttattattatcgatgaagagcacgagagcagttataaaagtgagacacttccgagataccatgcaagggagactgcgatcgagcgtgcgagaatgtgcggtgcgagtgtcgtgcttggctcggcaactccgtctgtggaaagttattacaaggcgaaaacaggggagtatgagctgttagagttaaagcaccgtgtagcagaaaaaccactcccgaaagtagaggtcgtggatttaagggaagagttaaaagcaggcaaccgttccattttaagtgtacggcttcaggagctgatggaggaccgcctgaaaaagggacagcagatgatgctttttatcaaccggagaggggttgcaggctttgtctcttgcagagcctgcggtcatgtgttaaaatgtccgcattgcgatgtgtctctaagccagcatgtgacaagacagcatccggaaggaaaaatggtctgtcattactgcggatatgagataccgatgccgaaaacctgtccggcgtgtggttcgcggtatatcagcggatttaaggcgggtacgcagaagattgagatgatcgtcaaggaacgtttcccacaggcgagggtgctccgcatggatatggacaccacgcggaacaaggaaggctatgaacagattttatctgcttttgccaatcaggaagccgatattctgatcggaacccagatgatcgtcaagggacatgatttcccgaatgtgacgttagtcggtgtgctggcggcagacctgtcattatatgtcagtgattaccatgcagcagaacgcactttccagctgctgacgcaggcggctggaagagcagggcgcggaagtgaacccggagaggttgtgatccagacataccggccggatcattacagtgtgcagactgcaaaagagcaggattatgaagcgttttatgagcaggagatggaataccgcaggatgcttttatatccgccggtctggaatatgcttgtgatcttatgtgcatcaaagcaggagcagaccgcttatgattccgcaaagcttctggtacaggagactgacgcctggcaggagaacatcaaagctgcaatggagcgcgtgggagaggattttaaaaagaaacgggttttcccggttggacctgcggatccggcagtggcaaaggtaaatgacatctataaaaaggtgatttatataaaaacaaaagattatcagacactggttgagttgaaagaccgtctcgaacattatatgcgcgacaacagggcatttaaagatacggtcgtacagtttgattttaatccaatgagtggtttttaaaaacaaggaggactttatggcacttagaacaatccgtgtacagggagatcctgtattagaaaaaatctgtaaacctgtgaaggaactgacaccgcgcacaagagagctgatcgaggacatgttagataccatgtacgaggcaaatggcgttggacttgctgcaccacaggtgggtatcttaaaaagaatcgtagtgatcgatgtgggcgagggtccggtcgtgatggtaaatccggttattctggagacttccggggagcagaccggcgatgagggatgtttaagcattcccggaaaagccggacaggtcacaagaccaaattatgtgaaggtgcatgcatttgatgaaaatatggaagaatatgagattgagggcacagagttaatggcaagagccatgtgccacgagatcgatcatctggacggacacctttacgtggaaaaagtggaaggtcagcttcatgacgttacctatgaggaagaggaataggcgcagagggaagagacagaaaagaaaccggaagcgaggagagaatcatgagagttatatttatgggaaccccggattttgcagtgggtacattagaggaaattataaaagcaggacatgaagtagtgctggttgtctcacagccggataaagcggttggaagaagcagggcattaaagtacacaccggtgaaggaatgtgcggttgcacatggaatcgaagtgtatcagccggcaaagatccgtgcagaggaaagcgtggaatatttaagacagtacaatgcagatatcatcattgtggaggcttttggacagatcattccaaaagcgatccttgatatgccgcattttggatgtgtgaatgtacatgcgtccctgctgccgaagtaccgtggcgcagccccaatccagtgggcagtgttaaacggggatcaggtcacaggtgtcacgaccatgcgtatggatgaagggcttgacaccggggatatgatcatgaagcaggaagtgatcgtggatgagaacgagacaggcggaagcctgtttgacaagctgtcagaagtaggtgcaaagctttgcgtgaaaacgatggaagcgattgaaaacggtacagcagtctacacaccacaggatgacgcacttgcaacccataccggaaagattcagaaagagatgggaagtatcgactggtcaaaagatgcagaggtgatcgagcgtttggtgcgcggtttaaatccatggccgagtgcatacacaaggattgacgacaagaacctaaaaatctggcgtgcaaaagtcatttcccatgaggtgaaagccgctccgggatgtattttaaaagtgacaaaggacgaactggaagtccagacggggaatggagtattagctttattagaagtacagttagaaggaaagaaacgaatgacaacggatgccttcttaagaggataccaggtgacagaaggcagtttcttaaaacgttgctgataagaaaggatgattactatgccatattattattacggatttgacccaacttattttcttgtgattatcggagcagtaatctgcatgatcgcttccgcaagagtaaaatcaacttataataaatattcccagtaccgcagtgcatcgggaatgacaggcgcacaggcagcacagagaatcttaaattccgcaggaatttatgatgtgacgatccagcatgtatccggaaatctgaccgaccattacaatccgtctgcaaagacattgaatctttcggattctgtatacaattccacatcggttgcagccgttggagttgcagcacatgagtgtggacatgcaatccagcatcagaacagctattttccactgacactgcgcacggcaattgtcccggtagccaatcttggttccacacttgcatggccgttgatcctgatcggattattctttacaagaaatacaggggcagttctgatcaatcttggaatcatctgcttctcttttgcagtgatattccagcttgtgacattgccggtagagtttaatgcatctgcaagggcattgcgcattttaggcgagcagggcattttgagtgacagtgaactcccatacacgaaaaaagtgttaaaagcagcggcactgacttatgtggcaagtgcggcggcagctattttacagttactgcgtctggtactgttatttggaggaagagaccgtgactgattctgtcaatacaagagaactgatcctcgggatcctgatggaagtgacaaaagagggcagttacagccatcttgtgatccgttccgtgctcgataagtatcagtatctggaaaaaaaagagagagcctttatcacgagagtatctgagggaaccattcagtacatgatcgagcttgactatatcatcaatcggttctccaaagtgaaggtaaacaaaataaaaccggtcatccgcaatattctgcggatgagcgtgtatcagttaaaatatatggattccgtgccggactccgcagtgtgcaatgaggcagtgaaactggcaaagagaaaagggtttggttctttgagcggtttcgtgaacggggtgctgcgcaatatcagccgcaatttaagcactatcacttacccggatgggcagaaagaccagatccaatatctgtctgtgcgttattccatgccggagtggatcgtgagacagtggatcaacgattatggcatggagcagacggtgagcgtgctgcaggcatttttgcaggagacaccggttacaatccgtaccaatcttctgaagatcacaccggaagcgctggaaaagcggttgaaagaggaaggcgttaccgcagagaaaatggtctgcgcagatatgccggaattaaactatgcatttatgatctccgggtttgaccatctgaatgcattggcaagtttccgtgaggggcttttttatgtgcaggatgtgagctccatgatggtggcggaaacggttgctccaaagaaggacagctatatcattgatgtgtgtgcagcaccaggaggaaagagcgtccatctggcagaaaaactcgggggaaccggtatggtggaggcgagagatctcacagagtataagactgatcttataagacagaatatcgcaagacatcagctttctaatatgcgggcagtacagatggatgcaacagttttagatgaggcttccatcggaaaagcggatgtggtgatcgccgaccttccgtgttccggtcttggtgtcatgcgcaggaagacggatataaaatataagatgacattacagacagaacaggaactcgtctccttacagagaaatatgttagaaactgtctgtcagtatgtaaaggtgggcggaacattgttatattccacctgtacaatggataaaatggaaaatgaagacaatgtcacatggtttttaaaacagcatccgcagtttgaacttgtgaaaatgcagcagatttttccgcagaaaacatatggagacggattttttctggcaaaattacagaaaaaagcgtgagagacttccggaacttctgatgaatgaaggagaattatggatcaaaaggaaaagacagatatcaaatcgctgaatctgaaagaactgactgtgttcatggagcagcttggagagaaagcgttccgtgcaaagcagatttaccagtggcttcatgggaagcaggcagcgtcttttgaggagatgaccaatatcccaaaggcgctgatcgaaaagttaaaagagaacagtcatctggtcagcataaaacaggaggcagtacagatctccaaaatcgacggaacgaggaaatacctgtttctgttagatgacggaaatgtcattgagagcgttttcatgcgatacaaacatggcaattcggtctgtatttcttcacaggtgggatgccgcatgggatgccgattctgcgcatctacattggacggtctcgtgagaggattgaccccatctgagatgttagaccagatttatcagattggaagagacaccggcgagcgggtttccaatgtggtcgtgatgggaaccggggagccaatggataatttcgataacctgttaaagttcattgaacttctgaccgatgaaaatggattaaatatcagccagagaaatgtgacagtatccacctgtggaattgttccgcgtatgcgggaacttgcagacaaaaaactgcagatcacgctggcattatccctgcatgcatccacgcaggaaaaacggctggaattgatgccggtcgcaaataaatatgagatccatgaagtgatcgatgcctgcagatattattttgagcagacaggcagaagaatcacatttgagtacagtttagtgggcggcgtgaatgacacggacgaggatgtaaggaatctgtgcaggctgatcaaaggcatcaactgtcatgtaaacctcatcccggtaaatccgatcaaggaacgtgactatgtgcagccggatgtgagagtgacaacggaatttaagaataaactggaaaagaatgggatcaacgcaaccatccgcagggagatgggaagagatattgacggagcctgtggacagcttcggaaacgttatatgggaagttgacttgttcttttacagtacgtgtgataaaataaagtgcatcgggcaaagtccgtgcagaaaacaatgacaggcgaagttaatgaaacattccgcatggaatgcacagatgtagcagtaagaaaggcaggaattggtaaatgaagacgttttccatgacacatattggaaggcgacgtgagatgaatcaggattatatgtatacgtctgagaacgcagtaggaaagctgccgaacctttttctggttgcggatggcatgggcggtcacaaagcaggtgagtatgcttccagattcacagtagaaaagattgtagagacgattgaaacatccggacagacagagccggtagcagcaatgaaggaagctgtggaggcggcaaacagaggtcttttggaagaggcgggcagggatgccgccaaggcaggaatgggaactacagtggtagctgccacagtgatcggagatcatctgcatgttgccaatgtaggggacagtcgtttatacttaataaatcacgaagctatcaggcagatcacaagggatcattctctggtagaagagatggtccgtttaggagagatggataaagcggatgcgaaagatcatccggataagaacatcatcacacgggcggtgggcgttgttcccgagttgtccgtggatttttttgaggttgagttaaagccgggagacacagttttaatgtgctcggatggtctgacgaacatgatcgaggatgaagagatcaaaaagatcgtgctcggacagagagatattgttgagaaagcagaaaaattaatagatactgccaacgagaatggcggaaaagataatattacggttgtgttgatagaaccattttctgatgaggtgaaggaatgttaacggaaggtatgtttgttggagatcgttatgagatcgtaaacaagataggaactggcggaatgtcagatgtatacaaagcgaaagatcatacacttggacgttttgtagcgattaaagtattgaaaccggaattttcggaggatgtcaattttgtgacaaagttccgcacggaagcccagtcggcggccggattagaacatccgaatattgtaaacatctatgatgtaggcagcgaaaatggcatgcattacatcgtgatggagtatgtggaaggaatcactttaaaaacttatattgagaaaaaaggacagctcacattcaaggaggctgtcagcattgcgatccaggtgggaagaggtattgaggctgcccataacaaaggcattatccaccgggatatcaagccgcagaacatcattatctccacagagggaaaagtaaaagtcacagactttggtatcgcaagagccgcaacatccaacacgatcagttccgatgtgatgggatctgttcattacgcatccccggagcaggcgagaaacggctttgtggatggcaagagtgacatttattcccttggtatcgtaatgtatgagatggtgaccggaagagtaccgtttgacggagatacgaccgttgcggtggcgatccagcatctgcaggaggagatcgttccaccgagtgcttacgcaccaaatcttccgatcagtatggaaaagatcatcttaaaatgtacgcagaagaatccggacagacgctatgagtccatgacagcgctgcttgcagatttaagaaaagcgttgatcagcccaaatgaagacttcgttgtgatcgcaccggtttcccaggagaagacacgtgtgatcggggaagaagagatcaataagatcaagcaggaaacaagcaatatttatctcagcgatgaggatgttgtgtcacataatcagaatcacagagacaaatttgaaaagcgtgaccgcttcgaagaggatgacgaggacgacgaagaggcatatgatgatgatgaactcgaagagatgaatccgaaaatggataaggcgatcacgatcatggggattgctgccggtgtcatcattgtcgcactgatcatttttattctggtaagcttcttcggagattttaaattcggaggatcttccaacaaagcaaacactgagacatccgaaacccagacagacggaattgaagtgccggatctgaagggtcttacattcgacgaggcaaaagagcagctcaatgcaaagggtctcggaatcaagaagaatgcgggaaccgttgcatctgaccaatatgatgagggacagatcgtaagccagacaccggatgcactgacaaaggcagaggcgaacacaacagtggaagttaccttaagcagcggaaaaggagaggtttccgttccttccgtgacaggcatggatgagacaactgcttacaatacactgacaaattcaggatttactccggtaaaagattatgcatacagtgcggatgtcgcacagggaaatgtcatcgaacagagcccaaatgcgggatcgcttgcaaagtcaggggacaatgtcaagatcgtgatcagccgtggtgaagagcaggcagaggcaacaagtgtagcagtacctggcgtgacaggacttaccgaggatgcagcaagatctgccatccagaatgtcggtcttgccgttggtaatgtgtcaagcgcctacagtgacagcgtgtcaagcggacagatcatttcccagagtccggttgcagatacagcagtggatgctggaaccgcagttgattttgtggtaagtatgggtgcagaacctgcacaggaagtaacgcctaccacttataagatcaatctgaacatcaaaaaaccaaataatgaatccgtggcagcagccaatatttatctgtatgatggagcagacggaacaggtaatatcttagagcagtggacgaaccagtctatctccttattcggggaggaaggtctcagcatttccaaatccggaatgttagcatccagcggttcattaaagattgactggcttggagcagatggacagcagcttggatcatcccagatcgtgtctccaatctcattcaaggcagaataataacaaaaggtaatatatgcagggaaagattgtaaaaggaatttccgggttctactacgttcatgtaggagaacccggaatttatgaatgtaaggcaaaaggtgcgttccgcaatcagaagatcaaaccgttggtcggagatgatgtggagattgcgattgttgacgaagaaacaaaaaaaggaaacattgaaaaaatcctgccgcggaaaaatgaactgatccgcccggcagttgcgaatatcgatctggcgctgattatttttgcagcggcaaaaccgcagccaaactttaatctgttagaccgttttctgatcatgatggaatatcaggatgttcctgtgacaatctgttttaacaaaaaagatctgttagaagaacaggcgattgaggaatttgcgggtgtatacaaaaagtgtggctattccgttctctataccagcgcggaaaaagaagaaggaatccgtgaactgcatgaactgttagatggcaggacaacagcggtcgcgggaccttccggcgttggaaaatcatcactggtcaaccgtctccagccaaatgtgcagatggagaccggaagtatcagcagaaagattgagcgtggaaagcatacgacgcgccattcggagatcataccgatcgcggcagacacatacattatggatacaccgggattcagtacactatatattccgggatttgagaaagaagatctgcagaatttctatccggaattcaaagagtatgagccatattgcagattcaagggatgcagccatatcagcgagccggactgcggggtgaaggaagctctggcagagggaaagatcagcccgctgcgctacgagaactataagctgctctatgaagaattgaaagatgtaaaaaaatattagaaaagatattaaaatatcattgtgcatgagaattatgttttcaaaattactttggaggaaaaagttatgaattgtttatcaccatccattttatccgcagattttgcaaatctgggagaacaggtgagaatgttggatgaggcaggcgcacagtatgtacatattgatgtgatggatggaatgtttgtgccaagcatttcatttggtatgccggtcatcaagagtatcagagagtgcagcgatcgtatttttgacgtgcatctgatgatcgaggaaccgggaagatatattgatgatctcgcagaagtgggagcggatctcatcacagtacacgccgaggcgtgtaaacacttggaccgcacgatcgaggcaatcaaagaaaagggactgcttgcaggtgtggcattaaatccggcaactccgttgtctgcgattgaatggatacttccaaaggttgacatggtgctgatcatgtccgtcaacccgggatttggaggacagaagctgatcccttacaccgtcgaaaaggtcagggcgttaaagaaaatgatcgacgagaagggacttaagaccgacatcgaggtagatggcggcgtgaatcttgaaaatgtgacagaagtcatggatgccggtgccaacattatcgtggctggcagtgcagtgttcaagggcgacatttctgagaatgtggaacgttttttagatgtattaaaggagtagtatgagacattgcatcattgtggtaggcggacatatcaatgacatttttgcaaaagagttcatagaaaaagaaagaccggagctttgcattgcggcagattccgggatgaactttttctatcggaataagttgaccccggactggatcatcggagatttcgattcagcatccagtgaggcgttagattatttcggcggacagcctgatatttcatggatcaggttaaacccggtcaaagacgatacggacacggaatcggcgatccggaaagcaattgcgcttggagcagagaaaattacgctgctgggagcaaccggaacaagaatcgaccatttgcttggaaatattgaacttctggggatcggactgcaaaatcatattccaatccagattgtggatgagagaaacagaattcgcatgatcggggcaggaatcacgattgagaaggaaaaacagtttggaaagtttgtatccctgatcccttatgcgaacgtagtaaaaggtcttacgctgaccggtttcaagtatcctctggatcattatgatttcaagggcttttgttcgctcggtgtgagcaacgagatcattgcagaaagtgcagagatagcctttgaagagggaatactgatcgtgatcgaggcgagagactgatggctgataacaaaatgccatttgttacttcaaaagccttgaaaaggactcctgcgacgaaagaaaacaaagacagaattaaatatatggattcacatgagttctcatttaaatttgacaaagttacaggaaaatttgtgagtgtaatcgaatgtgagtccgattgatctcagttgaatattaaattagaaatagtatctacttttggacaagtggtatgctatttaaggtaatgatcaaaattttgaaggaggtgtgatcatgagcaaattttttgatgatactatgcaaggattattggaagctgttgctattgataaaggggaaattcctttagtggaaaaggaagatatgcctgcacctacgttaattgcatcggaaagagagaaagagcctattcaggaagtaacaaagttacgaaaagaaaaaaatatttctcaaaataaacttgcggcacttactggaaacaagcaatatctcgtatggaaaagaatgagcatagtccatctttaaagctattctgcaatatggtaaatgcattaggatatgatataaaattagtgaaacaaaatatttaaattataaaagaaccaacggaaaaaactgaaggtgcttattttgggttagggcaagggctgagactgattctcagtccttgttaatttatatgaacgtgaagatttttgtttgcgaattgggattcttgtgctaatatggtaatatgtgacaatagtatgcaaaaaaataatggaaacaatgatgattttgtacaaaacacgaggcatagaaccatggaagttagttacaaaaaattatggaaagtattaattgataaggatatgaaaaagaaagaccttcaagcaaaggctggaattagttaggcatctgtaacaaagatgtcaaagggcgaaacgattagtatggatgtgcttatgaaggtatgcaaaacactggaatgtaatataggagatatcatggatcgcatccccaacacaaatgaaaacgattcagatatacatagttgattcacagggagtgatttaagttattgaaacgttatgattgaaatgaaaaacagaagtttgatagtaattggatcggagcatttatgagtgaaaaaagaataagaaaacttcttgaagcaggaatttatgatgatacaagaactgtggatctcatggatcgcttcgagggattcggtaaagatactgcatatgtgcagttggtgttgaggaatatagtttgtattaatattgagggtgattatgaatatcttagccttgttgtggaaagaagcaaggattatagatatgttggaaatattacctttacagaattgaagcagggacaaacacgggatttatatagctttcttaggaaacagttttctaaggaggttttagaacaatataagaataaagccgaagaatatcggtttgatacgtcatatttgtttcgtgcacaaaatagttctaatcgctctggctattactggagaggaatttatcaaggagcatgaagtttataaaaagagcttagacaaatgggtggaaaaattcgcaaaagctggaggaacattaaatctacagtctaacattgtactggcaaaaccgcagatggctgtacaggcggaattggtgcagagtaatagcacggcagcagtcattagttttgaagagagtaacttcgctgatcctgcggttgatgctttaccaataagggaattaaagaagtatttatcagcggagcttacagaacaggcatttgctcttttacagaataatggaataaaaaccattgggcagtttaaagccatgtcaccaaaggatgctgaaggcttaaaggcgaagggaaagcaaaccatacttagaaataatataatccgagcgattaataagttttctgcgatgattattaaagctaatgggccaaatgataattctgagactgaaaaagatgtcatcgatagcactgcggaactctcatctgatgaaaatgtagatagggaagctagtttgagtgcagaagaactattgtttgccaatacggctaactctgtcagaaattattttagaaaatttctgaacaatgatcctgaaaagatatattcatatatgaaggagcattatgaactaccgtcaaaactattcatgaatgagttatttgcttttgctgggacctatgttggaggagaagtattcttcacagactttggctgcagtgattgcgataactgcttttataacaagttttgttaattatatcttttttccatccgtagctttgtgtggagcaagtggtgtggtatttgcatttattttattatcttcctttacaagctttaaggaaggtgagataccaataacctttattcttgttgcagttttctttattggtcagcagatatgggaaggaattacagtacaggacaacatttcaaacatggcacatatcgttggtggagttatcggcggtttcttgggctatggattaaacgtgaaaacgagatttagcaggattatcaaatgacgtatgtaacgagaaggcaacgagcggaaaaaagaaagaagaagttcaagttggttgccattgctattatagcagtggcaattatttgtgttgccctttttggatttttgaaatggtggacttctgaagctcaccgaaaatatcaggcgagtcttaagatgccggattattctggacaggcatatgcagagattaatggaaatatgccgttttttgatgaagaggataagactacgaggagtttcgagaactacagtgaactggacagcctcgggcgatgtggtgtggcttatgccaatgttagtagagaattgatgccaatagaggatagaggcgaaatcggcagtattaagccttcaggctggcagcaggctaagcatgaagggatagttaattctagaccaccatatctgtataaccgcggtcatttgattgcttactgcttgacagctgagaatgctaacgaaaagaatttgattaccggaacgcggtatatgaatgttgagggaatgctgccttttgaggaacaggtggcgagatacctggataagaatgataaccacgtgttgtacagagtgacgccaatatttgaaggaaacaatctagtggcgagtggagcgctgatggaagcgtattctgttgaggataacagagcttggatatgtttctgcgtgtactgttataatgtgcagccgggagtgaagatagattataagaccggtgagagtaaggttgcgaagggaggagattttttatgacagatagtcagatcacgcaagaaattttaagatatatagaggattcatcctatgattatgcagtcttgattgacggagaatggggatgtggaaagacatactatataaagaattccttaattaaagatatagttagtcatgaaggtgaaaaggaaaatggacgtaaggtaaagtatatttcactatatggctgcaaaagtgttcaagatattcaagaaaatctggtatggagtgttgctgaggaagcgattgataagcttaaggacaatgccaaaccagagaataaggggacaatttcaaagatttcaaacaatgtattgctgagctcgcgcaaaatcggaaatgctgtaatgaagaaatttgctccagaagctgatacatattcaattgtgtctgattggctaattatgaacaactatatctttgtatttgacgatttagaaagatgcgattgtccgattaatgaagtgtttggcttgataaatggtttggttgaacatgaaggaactaaggttatattggttgctaatgaaaaagaaatcagccaaggcgttgatgacagtaatgaggcgctagagtaccttgtagctttagaaaaaggaattgattggccaaagaatgaggagagaaatagttatctgaatcgtcagaggaatactgatgtaattaaggtacaggaattagaaaggcgtagaagatggctttttcctactaaggacatgtcagaaaattataaaaagataagagaaaagctgataggagttactttgcgatatgaaccggatgttgaacagattattttattgatggtagagaagtcaattatcagtgatgatgataaacagatcctcatggatggaatgagaagtatgaagtctgtaatggattattatagacatcataatcttaggactttccaattttttctatctaaagccacatacctactagccaggatggacgaggtttctgtactggatgaatatgtgcagtgtataaaggcgagtgtaatagatgaatgctttagggcggcggttaagtataaggcgaacattaagcctgggaaatgggaacaggagataaatactaccaaagataacccgagatttaagtcaattttaaattatgtcgagaaaggtgagtttgtattagaagattacaaagctgatataaataagtacacagaggaattaaagcaaagtgttatgtctgatgatccttttaatcttctgtacaatcagtattactatcattcccagaagtggtgtgaagacaatattgaattgatgattaaaagattggaagaagacaagtatccaagatatacatatacaaaaatgctaataatacttgtaagattagtgagttatggatttaaagaggaatatttgtcaagggttaaggctgctatgataaacaatgttcaaaacagccctaatgcaattaaagttgataatgatttgttttttatagaagacagtgagttaaaagctcaaataaaagcggctattgatgaaattaatcaagctattgagtcaagtggggaaacagcaaggcgtaaaaatataaatgaaattttacatagtaataactgggttgatgagttagatggattcataaatccttctggcaataggtatgtggatgatatggcaatcttttgtcaggcagatagcgatgagtggtgtagagtttttcgtgaagcagattcagagcagattgatagctttaggcatacattgtcggaattgtatccgagaaatgttattaggaaaagcgcagaaaaagacttgccggttataaaagagattcttgataaattaaaacctgaagacgaaagtgatttaataaaaaaagcttgtgtggggtggttgatttatcagtttaccgaaattgtcaaaagctatataactgaagaataattttttcaaccccaccattaggtgagtagtttgaccaatatcattgcctcaaaacgaggaggtgtatgatatatggacagggaagagttagttattagatatatttaagcaacctgcctacagagcctgagaaggtgcctattctgctcaaggtgacgattacaataaaggaggcagcagaatattcaaatataggtataaacagcttgagaaccttttgagagctcctagatgtccctttgtactttacgttgggaataagaaattggtaaagcgaagggaatttgaaaagttcatttcagagaatattcaactataagggaactacaaatttggacatagtcgtatgtttttattgaaatccgaagtttcttatagtataatctttaatgctattttgtggcttctttttgggaaaaggagtcgaaaataggaaaagaccttaaaggtattaagagattgtcggtcgttcgatattggcattacgatgaacttgtatgttcatataaccgaagaaaaaatgaaaagaaattaaccttgtggcggtagctccgaaggtggtgtagcaggaatataattctatatatcttgatgaaaaaatcatccattggtgcacctgaaaaattaaggagccgaaaaagcccgtaaaataaaggttttcaaaggagatataaaaattatgaaattaggaatcgtcggacttccaaacgttggaaagtccacattatttaattccctgaccaaagcaggtgctttatccgcaaactatccattcgcaacgatcgatccgaacgtcggaatcgtttctgtaccggatgagagaatcgtaaaactcggtgaactttaccatacgaagaaggtaacaccggctaccatcgaatttgtagatattgcgggacttgtaaagggtgccagcaagggcgagggtcttggcaaccagttccttgcaaatatccgtgaagtagatgcgattgtacatgtggtacgttgttttgaggataccaatattatccatgtggatggatctattgatccggcaagagatattgagaccatcaatctggaactgatcttttctgatattgagattcttgacagaagaattgcaaagatttccaaacaggcaagaatggacaagacacttgcaaaagaactggagcttgtagaggcaatcaaagcacatctggaagccggtaagatggcaagatcttttgaagtgccggatgatgaagatgcggaaatctggttcaaaggctataaccttctgactgcaaaaccgaccatttacgcagcaaatgttgcagaggatgatcttgcagatgacggagcatccaatccacacgttgcaaaagtgagagagatggcaaaggaagagggcgcagaagtatttgtgatctgtgcacagattgaacaggaacttgcagaactcgatgaagatgagaaaaaggaatatttagatgaccttggagtgacctcaagcggacttgataaactggtagctgcaagctacagcctgcttggactgatcagtttccttaccgcaggggaggatgagtgccgtgcatggacaatcaagaaaggcacaaaagcaccacaggcagcaggtaagatccatacagactttgagcgtggatttatcaaggctgaggttgtaaattatcaggatcttttagataatggaagccttgcggcagcccgtgaaaaaggaattgtcggcatggaaggaaaagagtacgtggtcaaagacggagacgttattttgttccgctttaatgtataagagataaaaaaacgcatatcatttttcgagggaatgtttcggagaatggtatgcgcttttgtgacttgacagaaaaagaagtgataaacgtctgtgactgcaaatgccttggaaatgtccatgatcttgatattgacgaatgtgatggaaggatacgggcgttgatcgttccgggacccggaaaatggtttggctgtttttgcagggagttcgaattgtttattccgtggtgtaagatcgtcaggatcggaccggatattattttagttgatattgatgagaaagaggcaaaacacaaggtttaaagagaagaaaacaggagagactatgttagatcagagtgtatttacagagacaatccatgaggtggcagagattatccgcacttctgcgacaccgttatcaaaagaagaaatcttaagctatttcaaagagatggagttgaacgaacagcaggaaagcatggttttagagtttctgctgacaccacatgaggaagaagaagcggaagaggaaacggaagagaacgaaggcggagagcaggaagcagcagactggcaggaaacgtcagatgcatctgtgctggcgcagaaggatcctgacaaaaaagaggaaaaaaacgcagagccggatgttttaccggaaactaaggtatttcagatgtatctggaggagatcagcagtcttccggtatattccgggaagaagcaggaagaaatgtatcagaaacttttagcaggggatgagtccgtgatcaatccaatctctgacagctggatgataaaggtgttagagaccgccagaaagcttgcagtgacctcagaaggctttgaggatgtcattcaggaaggaaatatggcactttttttaaaactgacagaactttgcggctgtgaggaaaaaacagatgttgaggcagaattgcagggcgcagtggagacagccatgaaatcatccattcttgcggaagaaggcgaggatgaggatgagaaggctatggtcggcaagctggcgttagtcaacgaggctaagaagtatcttgcagaggagaaaggcagggaagcaactgtacatgaacttgcagcatatacacagttgacagaagaggaactttctgatatcctcttattgattcagaaagcggatcagaaggacaaatagcatatagaatccaaaaccaatattggagtggacttttctggagcaaaaagctctatttttcgccacacgactgaatgtgaacagtcgtgtggtatttttttgcgctaaaacagatatttcagcatatgcgagtaagattgattgacagaaagaaaacagaggagaaaaagaaaagatggatcaggaatttatgaaagaaaaaccggtgatgccgctggtgatctccatggcgctgccgatgacattttccatgttagtgaatgcattatataatatcatagacagctactttgtggcgcagatcagtgaggatgcgatgacagcgttatcgttagtatttccgttacagaatctggtcaatgcagtggtcattggttttgctattggaataaatgctgcgatggcttattatcttggggcacagaaacagcagctggcagataaaacagcatcgcttggcatgttattgaatatgctgcatggtctggtgctggctgccatctgtattgcagttatgccagcctttttagggatgtttacaaaacaggtcggaattatcggaatgggggtacagtactcggatattgtatttttatttgcagtgccaaatgcggcagcgctttgttttgaaaaaatatttcaggcagttggacgcatgaaaacatctatgttttgtatgctgcttggctgtgtgaccaatattgtgcttgatccactgctgatttttggaattgggatttttcctgcaatgggaatccggggagcggcacttgcaaccggaatcggacagatcgtgtcactggcagggtatctgaccgcatattactggaaaccgattcctgccaaagtgaaggtcagaaatatgaagccggagaagcagctttgcaaaaaagtgtattctatcggaatccctgcaacgttaagccttgcgctgccttcagtccaggtgtctgcattaaatgcgatactggctgtttattctgcaagttatgttcttgtattgggtgcttatttcaaattacagacatttttgtatctgactggaaatggtgtggtacaggggatgcgtccattgattggatacaattatggagcaggagagtcaaagagagtgaaagagatttttcggtcagcattgttcctgatcgtaatagtgatggtgatcggtacgattctctgtatggcagtgccacaggcgctgatcggtctgtttacaggaaatcctgagacaatccggctaggcagggaggcactcaggctcatcagtataggatttatcgtgtcatcggtttccgtcacggtatccggcgctttggaggggcttggaaaagggaaggaatcgttagttatttcattactgcgttatatcgtggtgattttgccgctggcatttattttaagccgcctttttcaggcggctggtgtatggcatgcgttctggatcacggaatttgtttcagcagtgatctcatggatcatatgcaaaaaagagatttttcagtgaggcacatccagcaatgtttcaaactggtcaatcggaacaggtttggaataaaaataaccctgataccaggtcgcaccaaattgatgaatgtagtcgcttacctcctgattttcaattccctcgatacaggtttcggtattggtacggtttgcgtaatcaacgatcgactgtaccatagactgattctgtggcttttgttcaatatctttgataaaactcatatcgactttcaactcatcaacaggtaattccaaagcaagacttagggagctgttaccggttccaaaatcatccagtgcaattttaatcccctttgagtgaaagaaattgacttcatttttcagaaaagtcacatcgagatcccggcagcgctcagtcagttccagacacaattcctccggtctggctccggtttcttttaaaatcgtcatgacagagtcacgaaattcttttcgcgacaattgagcggcagagatgttgacgtttacgaaaaagtgtgggatcttatcacgaatcctgccaatatcctttaatgcggtgcgtaagatccagttgccgaggtcaaagatacatggatcttcctctagccactccataaatattcctggagagatgagaccgtagggttctaattcccatcgtatcagtgcttccatgccacggatctttccggtctttgtgtctgctatcggctggtagaacaggcggaatccctcaaaatggctggtcgcacactggtggatcagaccgatcagctcaaactgtttttcgttgttgccacagatctcatcgttaaaaatgacgagatcgccatgatgttcatagcgtgaatgattctgcgcataggtcagacggctgcggacagcattcgtttctttcatatagggttctaagaaaatggctcctgcagagatcttgatcggaatccgttttccgttcactgcaatggtgtttgccagtatatcctcgatgaaagcgaagatgctatggagctctgttttggatattttgtcgaaaacaagcacaaatttcgcaccggacaggcggtaggcataaccgatatggtgtaccatgtgtaaaaggctttgtgccactttgttcagaatcttatctgcaaaagctgccccatacatgacattgatatggctgaactgatccagcccgatctttaagagtgcggcaggacgtgtgttatcaagtaattgggtgatacagcggttcagtgccggctctgtatagagacctgtgacagagtccacttcatcagaaattccataattatcatagcggataatgatgataaaaggctgcttttgttcatcataaagtacacgcgccatggcgttgaaaaggttgtaggaatcgccatcctgaatccggtattcccatgcggtatccagatttttaccgtcaacccgttctttaaaaccatgtttgaaagtggctacatcatcaggatggatcttccggtttgccttttccatgccgcggatcgtataattttctttcatgccaaaataatccatcgcctgttcggaccaccaggtgattccggtccgaaggtttgtaatggaaagatatgattttttggaaagagaggcgatcgcttttatcatatctggaaaaagccggtcgatctcttcctagaaaagctgttcatgattgtcagttttatcgtttttcattcgttttccccgattgacatacgcacgcatgtcttttcacaatgtacacataaccaataactaataaagctatttgtgattatagcataaaacaaattaaatttcgagttttttcgtattaattcatagtatcttttttcaggttcttatttgctgttgaaagcatgagtttaatacggttcaactggtttacttcacttgcacccggatcgtagtcgatcgcaacaatgttggaatccggatagcggtgacgcaattccttgataacaccttttcctacaacatggttcggcaggcaggcaaatggctgcgtgcagacaatgttcggagtgccggtatggatcagttccaacatttctccggttaagaaccatccttcaccggtctggttaccttcggatacgatatcccttgcatattttgcaagatcctcaatgtgtgcaggtggagtaaaatgtttactcttcttaaattcatcaaccgcagcagagcgcagccactcaaagaacctgatgccaaggcgtccgatacgtttggatttctggctgaaaccgaggttatctgccttaaagcctgtgttgtagaagcagtagagcaggaagtcggtaaggtcaggaacaacagcttccgcaccttcggattctaacaggtctgcaagatagttgttggcagccggatggaatttcaccaaaatctcaccgactatgccgacacgcggctttttaatatcaagacgtgggagattgtcaaagtcacggatgatctcacggcacatctgcttgtattttttatgggataaaatcttatcttgtgtaataaatgcgatgatcttctttttccacttcgcatggagttcgttggcagaaccgggaactgcttcataaggtcttgtggcgtataaacagcgcaggaaaatatcaccaaattccagtgcgtaaagtccatgctggatgagctttggagtgaaagtgaatcccgggttgctctctaaaccgctcaagttgatggagataaccggaacattcggatatcctgctttttccaaagcgcggcggataaatccgatatagttacttgcgcggcatccgccaccggtctgggagattaagatcgcagtcttattcatatcgtatttgccggattttacggcagccatcaactggccgacaacgatcagggacggataacaggcatcgttattgacgaattttaatccgacatcgacacattcccttgcaggaacatccggtacgaccagattgtatccggcagcattgaaagccggctctaataattcaaaatggatcggtgacatctgcgggcagagaatcgtgtagttttcacgcatctccttcgtaaataccacacgctcataacttgcaggcacgatcgttcttttggtctgctttttctcgcggacgcggatcgctgcgatcagtgaacggatacggattctggcagcacctaagttgttgacctcatcaatcttcagacaggtgtagattttgcctgatctggtcagaatatcgttgacctgatcggtggtaacggcgtcaagaccacatccgaaggagttcaactggatcaggtctaagtcatctcttgtctttacaaagtttgcagccgcatacaggcgggagtggtacatccactgatccataacgatcaacggacgctccggctgatgcagatgggagacagagtcttctgttaaaacggcgattccataggaagtgataagctccggaataccgtggttgatttccgggtcaacgtggtatggacgtccggcgagaacgataccgcgttttccggtctcttccatatattttaatacttcttcaccttttttctgcatttccatgcggacaacagctaattccttccagccttcggaaactgcatcacggatctccgcttcggaaatgccgaattcagaagaaccaaataccttgatgagctgggaggataaggtgtcctcatttgtgaatgccataaatggatttaagaacttcacctgaccggaagtgatctcatccacattgtttttaatattctctgcgtaagaagtaacgatcgggcagttgtagtggttgttggaatccgggaactcatttctctcgtatgggatacacgggtagaaaatgaaatccacattctgatggatcagccaggtcacatgtccgtgtgcaagttttgcagggtaacattcggattcggatgggatcgaatcgataccaagctcgtaaatcttacgtgtggaggacggagagagtaccacggagaaacctagttttttgaaaaagactgcccagaatgggtagttctcatacatatttaatacacgtgggatgccgacggtaccgcgggctgcttcctctgcacttaatggttcatagtcaaaaatacgtttgttcttatattcaaaaaggtttggaatgttgtctttgttcttctcttttccaagaccacgctcacagcggttgccggtaatatactgacggttgccggagaagcggttgatggttaagagacagtggttcgtacatccctgacatcttgcaagcttcgtgtcaaaagtcagtgcattgatctcgtcgatggagagcatggaggtctgataaccttcctcatggcgttcccttgcgatcagggcagcgccgaaagctcccatgataccggcaatatccggacggatacactggacaccggcaattttttcaaaacttcgtaaaacggcatcgttgtagaacgttccaccctgtaccacaatgttctgaccaagatcttttgcatcggaaagcttgattaccttatatagagcattcttgatgactgagtaggcaagaccggcagaaatatcagcgacggatgcgccctctttctgcgcctgttttactttcgagttcatgaatactgtacagcgggttccaagatcgatcgggtttttcgcaaaaagggcttctctggcaaagtcctgtacagagaaatttagtgattttgcgaatgtctcaatgaaagaaccacaaccggaagaacaggcttcatttaactggacactgtcaacggtctggtttttgatcttaatgcatttcatatcctgaccaccaatgtcgaggatacagtcaacttccggatcaaagaatgctgcggcataaaaatgtgcgacagtttctacttcgccgtcatctaatttcagagcagccttctgtaacgcctcaccatatccggtggagcaggagtgtacaatgtgtgccttttccggcagtttggaataaatatccttgatcgcacggatcgcagtagagagcgggcttccgttgttattgctgtagaaggagtacagcagagaaccatcctcaccgatcagggcaactttcgttgtggtggaacctgcatcgataccgaggtagcagtttccttcgtaagaagccagatctgcggactttacatgatgtccgtcgtggcgtgtgcggaaagcatcgtattctgcctgatctttgaataaaggatcaagtcttgcaacttcgaattccatatggatatcggactgaagttttgtatgtaattctgccaaagtagttactttgtcctctttatagttcagtgcagaaccgatcgctgcaaaaagatgggaattctcaggggtgatcgcgtgctcctcatctaagtttaaggtacggatgaatgcagcctttaactcggataaaaagtgcaggggacctcctaagaaagcaacgtgtccacggatcggtttgccgcaggcaagaccgctgatcgtctggttgacaactgcctggaaaatggaagcggataagtcttccctggttgcaccttcgttgatcagaggctggatatctgtcttggcaaatacaccgcatctggcggcgatcggataaattgccttataattctttgcgtattcgttcagtccggttgcatctgtctggatgagggatgccatctggtcgataaaagaacctgtaccaccggcacagataccgttcatacgctgttccacattaccgccctcgaaataaatgatcttcgcatcctcaccgccaagctcgatagcaacatcagtctgtggtgcatagtgctgtaaagcagtggatacggagatgacctcctggacaaacggcacgtctaaatgttttgcaagggtaagaccaccggaaccggtgatcattggggcaatctgcatatccccaagctgtttataagctttttccaccagcagggagagagtttcacggatattggcgaaatgtctctcgtaatcggagaataacaggttgtcattctcatccagcacagctactttgactgtcgtggaaccaatatcaataccaagtttatgaagtgtattgttactcatatctttcctccaaattatctcttgtaaatcagatctatcaatagtctatgttcactatttcttcctattatatatatgtgctcaaaaaccaagcaatgtacattatacgacaggaaaaaacaaaaaacaatgacaaaataatctgaaaaatctaaactttttatgaagaaatttagcgccgattgacaaaggtttcctgcatagatatactttagctagattgtttgaaaaagaagacagtccaaagagtatttgaaaaaaaggagcagcaatatgaactggttaaataaactggagcgtaaatttggaagatatgcggtaccgaatctgatcgtgtatctgatcggagcatattccgttggatttgtattgaacatggtggcaccgaatatattgggattcttgaatttccagccttattacattttacacggacagatctggagacttatcacatggattttaatgccgacagacagcaatatcatttttctgttgatcatgatgatgttttattatcagcttggaactgcgttggagcgcgcgtggggaactttccgttttaatgcctatatcatcggcggaatcctgctgactgaagtgggaagccttttggcgtatggtctgatctatctgtttatgggtggcagttttgcccacactgcaagcacaatgatgggacagatgatcagtacttcctatatcaatatgtctatattccttgcatttgcgaccttatatccggatatgcaggtgttactgtactttatcattccgataaaaatgaaatggatggcagccgtatatgttgttatcatggtattcagcgtgtgggatacctatcatgcgatttatgcatatacacagtctgtatccactgcattatggtatgcagggattatgctgttatgcattgtgatgtcactgttaaattacctcattttcttcctgtccacgaggaatctgagccggtataccccacatgaggtgcatcgcaggcagcagttcagggcgcagatgagagagccgcgacctggttccggtatcgcaaaacacaaatgtgcggtctgcggacggacagagctggatgatccaaatttacagttccgtttctgttcgaagtgcgagggcaattatgagtattgtcaggatcacctgtttacacatcagcacatcagaagagtataagaacaaagatacagtctttttccagatgacggagaaagactgtattttttattagttaaaaatatctcctgtattagttcatcttatcaataaaaaattttttgcaaaaattgacgtttttttgaaaattaccatacaaatcatattgacgataaaaaattgctatgctaaattgacttttgtattttgagattagtttttctaatgcaaaacaaggaggattatatgaaaaaggcattaagtattttattggcaatgggaatgactgtcggtatggtggcaggatgtggagacacagcagacaacagcagtgcagcagcttctacagaggctggtacagatggcacacaggcagcagcttccgcagcagatatcaaagtcggtgttatttatatcggtgatgagaacgagggatatacagcagctcatatggcaggtattgatgagatggcagcaaaccttggtttatcagatgaccagattattgagaagacaacaatcccggaggatgagtcctgctatgatgcagcagtagaccttgcagatcagggatgtaatattatttttgcaacaagttttggacatgagacatacattttacaggcagcacaggagtatccggacattcagttctgtcatgcaacaggatatcaggcagcaagttccggactttctaacatgcacaactacttcgatgcaatttatgaagcacgttatgtatccggtgttgttgcaggtatgaaattaaatgagatgatcgagaatggtgatatcacagctgaccaggcaaaaatcggttatgtaggtgcattcccatatgcagaggttatttcaggattcacatctttctatttaggtgctaagagcgtatgtgaatctgttacaatggaagttcagtatacaaacagctgggcagatatgacagcagagggcgaagttgcaaatcagctgatcgcagataactgtgtactgatcagccagcatgctgatacaacaggtgctccatcagcatgtgagacagcaggtgttccttgtgttggttacaacgtagatatgacatctgttgctccggacgcagcattgacatctcctacaaataactggggtgtatattatacttacgctgtacagtgcgtattagatggaaaagcaatcgacacagactggtgcaaaggattctctgaggatgcagtcagaatcactccggtcaatgaggctgttgcagcagaaggaacagacgcaaaagtagaagaagtagaagcagcattaaaagatggttctcttcatgtatttgatacatctacatttacagtaaacggatcttccttagaagacctgatcgcagaaggcggagattacgcaaaatatgctgattacgtttcagatggttattaccatgaatctgaattagcatctgcaccatcctttgatattatcattgatggtatcacatctcaggcaaactaatttttaagataagccggcagggcacagatggtttctgtgctctgcaatgatagaaatattggaagaaaacagataaatcctttcaagatacagattgaaaggattttcgtatttaggaggattacttgtggaaacaggaaacgctattgaactgaaaggtgtaaccaaacgtttcggtgacgtgattgcgaacgataacgtgaatctgaccgtcaggaaaggtgaaattctttcaattttaggagagaatggtagtggaaagactacgttgatgaacatgctttccggaatttacttcccggacgaaggagaaatttatgtggatggaaaagaagtgaccatccgctccccaaaagattccttcgcgctcggtattggaatgattcatcagcatttcaagctgatcaatattttgacagccgccgagaatattattttaggtctgcctggaaaagaaaaactgaatatgaaacaggtagagaaagaaatcagggaactgacagaacagtatggatttgaccttaatccgtcccagaaaatttacgatatgtctgtctcacagaaacagactgtagagatcgtaaaagtactttaccgcggggcagatattctgatcctggatgaaccgactgccgtattgacaccgcaggagaccgaaaaattatttgctgttcttcggaacatgagaaaagcaggaaaatccattatcatcatcacacataaattaaacgaggtattggaactttctgaccgtgtcgccgtgcttcggaaaggaaaatatattgatacggtagagacggcgaaggcaaccgtagaatcactcacagagatgatggtcggcgagaaagtaaaactggatatcaaccgtaccgagcctgtaggagcagaaaaacgtattgagatgcgtggcattacgtgtaagaacaaggagggacttaaggttctgacagaggcttccttcaccgcctacagtggggaaatccttggtgtggcaggaatttcaggaagcggacagaaagaattattagagtccgttgcaggacttcagccgatcgagagcggcgagatcctttatttttccccggagggtacgacagaaaaaatctctgagatgaaggcggaggatattaaaaatcttggtatcacgttatcgtttgtgccggaagaccgtcttggaatgggacttgttggttctatggatctgacagataatatgatgatccgaagctataaggaaggcagacatttctttgccgaccgtaaatctccaaagaaacttgcagaagatattgtggagaaattagatgttgtgacaccgggtgtggatactccggtcagcaggctttccggcggtaatgtacagaaaatccttgtcggccgtgagatcgcaagcaatccgactgtgctgatggttgcgtatccggtcagaggacttgacatcaattcatcatacacgatttacaatctgttgaatgaccagaagaaaaaaggagttgcagtcatctgtgtaggtgaggatctggatgtcctgctggaactttgtgataagattttggtattgaacagtggaaaagttgcgggtatcgtggatgcgcgtaccacaacgaaggaaaaactgggactgatgatgactggtttgacggaggataagaatgagtaaggaaaacgtgatttcgaagaaagaaccttttgcacgtatggtgaagagagaccatatcagtgtgggaaaggcgtgggcgatccgactgatcgcagttgcattgtcactggtagtagcggcacttgtgatcgtggcagtcacaaaacagaatccgatcgaagtgtatcttggaattattgatggagcagttggaagcaaccggaggatctgggtgactatccgtgaaatgatggtgcttttatgtattgcaattggtcttacccctgcatttaaaatgaaattctggaacatcggtgcagaaggacagattttaatgggcggtacagcggcagcggcaatgatgatctactttggcgataaaatgccaaactggttactgctgatcgtgatttttgttgtcagtggtctggccggactgatctggggtgtgatccctgccatttttaaagcatattttaataccaatgagactttatttactttaatgctgaattatgtcgcaatgcagatcgtaacgttctgtattgtattctgggagaatccgtctggttctaataccgttggtattatcaatgcagcaacaaaaggtggatggtttccaacaatttttggcaatgcatatacattaaatgttatcattgttttagcaattacattagtagtttatgtttatatgaaatattccaaacagggatatgagatctcggttgtcggagaaagccagaatactgcaagatatgcaggaatcgatgtgaagaaggtcattatccgtacaatgatgatctccggtgcgatctgtggaattgccggtgcagtgatcgtcagcggtgcgagccataccatctcgacaagtacagcaggtggacggggatttactgcgatcattgttgcatggatgtcaaagtttaatccgcttgcgatgatccttgtttccggattccttgtatttatgcagcagggatcgatccaggtggcatcgcagtttggtctgaatgaaaatgcatcagatattattacaggtattttattgtttttcctgatcggatgtgaattctttattaactacaaattagagttccgtaagaaaggagagaaatagaatgacattattactgacgtttatacagaaggcgatcggacagggagtcgctattttatttggtgcttccggagagatcgtcacagaaaaatccggtaacttaaacctcggaattccgggaattatgtacatgggtggtatcgccggacttatgggtgctttcttttatgaaaaaagtacagagacgccaaacggagccatcggggtgctggtttcactgctgtgttccctgatcgcatctgccctgggcgggctgatctacagttttctgacaatcacactcagagcgaaccagaatgtggtgggacttgcacttacgacatttggtgttggattcggtaacttcttcggtggttccatttccaagctggctggaggtgtcggacagatttccgttcagacaacggcggctgcataccgcgccactattccgggactctcaaagatcccggtgatcggaacacttttcttttcttatggattcctgacatatctgtccgttatcgtggcggttgtcatgacttactttttaaagaaaacaagaaaaggactgaacttaagagcggtcggcgaaagcccggcaacagcggatgcagcaggtatcaatgtctcaaagtacaaatatgctgccacagtgaccggcgcagcaatcgcaggtcttggcggactttattttgttatggaatatctgggtggtacctggtcgaacaatggattcggtgacagaggatggcttgcaatcgcacttgtaatcctggcattgtggaatccggatcatgcgatctggggatcttttgtgtttggtggattatatattttatatatctatcttccgggattgaatagggcaacacaggagcttgtaaaaatgcttccgtatgttgtgacaattatcgtcctgatcatcacaagtaagagaaataaacaggaaaatcagccgccggcaagccttggagaggcatatttcagggaagaccggtaaaaggcatgaaaaggaagcgaagctgcctgggtgcagccgcttcttttttgttttgtaaatagctggaaaacagtgaaaagtatgctataataaagaatgtcgagcgattttatgcttgcgtctgaatcatacatcatgtaatatgttagatagacttcatttttgaaaaacaaggaggaaattatggaaaacgagactgtctctaagaattttattgagcagatgattgataaagatatcgaggagggatactgccatgaggttcacaccagattcccaccggaaccaaatggttaccttcatattggacatgcaaagtccattcttttaaactatgggctggcacagaagtacggcggaaagttcaatcttcgatttgatgatacaaacccgaccaaggagaaaacagaatttgtagaggcaatccagtctgatattgaatggcttggcgctgactgggagggaagactgttctttgcatcggattatttcgaacagatgtatgaaggagctgtaaagctgatcaaaaagggaaaagcttacgtatcagacctttccgcagaacagatccgtgaatacagaggaactttgacagaaccgggaaaagaagatccatacagcacacgttctgtagaagagaatctggcattatttgaagatatgaagaatggtaagttcgccgatggagaaaaagtactccgtgcaaggatcgacatggcatcttccaatattaatatgagagatccggttatctatcgtgtggcacatatgacacaccacagaacaggcgacaaatggtgcatctatccaatgtatgactatgcacatccaatcgaggatgcgatcgagggaattacccattctatctgtactctggagttcgaagaccacagaccattatataactgggtagtggaagaagttggcaaagatatgatcccaaataaggatgagatgccgccaagacagattgagtttgcaaaattatacctcacaaatgtagtaaccggaaaacgttacatcaaacgtctggtagaagaaggcatcgttgacggatgggatgatcctcgtctggtttcgatcgcagcgctcagaagaagaggatttacaccggaatccattaagatgttcgtagatctttgcggaatctccaaagcaaacagttctgtcgattatgcaatgcttgagtactgtatccgtgaggatttaaaattaaagaaaccgcgtatgatggcaatccttgatccggtcaaggtagtgatcgataactatccggaaggacagatagaatatctggatgttgtgaataaccttgaaaacgaagaacttggaagcagaaaagtgccatttggaagggaaatctacattgaccgtgaggactttatggaagagccgccaaagaaatatttccgtatgttcccgggaaatgaagtccgtcttatgaatgcatactttgtaacatgcaacagcttcgtgaaagatgagaacggtaaagtgacagagatccactgtacctacgatccggcttcccgcggaggaaacagcccggatggacgtaaagtaaaaggaacgatccagtgggtatctgctgagaagaatgtaaaagcagagatccggttgtatgaaaatattgtggatgaagagaagggtgtatacaatgaggacggaagcctgaacctgaatccaaactcactgacagtattaaaggactgttatgtagaggagaatcttgcagacgcaaaggcttatgacagcttccagtttgtgcgtcagggattcttctgtgtagatgcaaaagattctacaccggaacatctcgtatttaaccggatcgtttcgctgaagagttcatttaaattaccgtcaaataactaatttacgatcaagaaaagcagtcaatattggaggaacgtatatgaatttattcaagggactggaaaagttcggtctgaagacagagggtacagaaaatctgtttgaagaagaaaaaaggaccaatgcatcaacagagcagggagaggcaaaagaagaaataccttctgaggaatcatttctgttagaaaaatcagtgcgctgcactgtgtgcgataaagtgttcaaaacaaaaatgatcaaaaacggaagagtgaaacgtctcgaaccggattttgatctgagaccaagatttatgtatattgatactttaaaatatgatgttgcatcatgtccaaactgcggttatacagcaatgaaccgctactttgaacatctgtcatcggtccagatcaaactgatcaaagagaaaatatgtgcaaattttaaaccgactggtgaagaaccggcggtatatgattatgatacggcaattaaccgttacaaactcgcactgtttaatactctggtaaaaaaaggaaaagcaagtgagaaggcatatacctgtcttaagatttcatggctctatcgtggaaagttagagggcatggatgagaaggatgcttcgctggaacaggaacgcagggagtgtctggagcagcaggaggcattttataatcaggcttatgaaggctttttaaaagcagtatcaactgagatgtttccaatgtgcggcatggatcagacaacagtagattacctgttagctgttatgtcaaagcatttcaaacgttacgatactgcgtccaaatgtatttccaggatcttgtctacaagctctgcttctaagaagatgaaggatcgtgcattcgatctgaaagaggagatcatccgggaaattaagacttccaaagcgtaaaaggcggcaggggataccagacatcagaattggcaaagagtaagaggattgcaatgaacgagattatgattgatctgcaggggggcgcgaaagcgcccctttatgaaaaaatatatgaatatataaaaaatgagattgttgacggtaagatttccaaaggggaaaaattaccgtcaacccgtttattggcaaaaaatctgtctgtgagccgcagcacggtggaactggcatacgatcagcttttggcagaagggtatattgaggcagaaccataccggggatattttgtctgtgatattgaagcgttgtatcagttagaacagcggaatcacatgcaggaaaaactgcaggcagggcaggactggcagccgggatggaaaactgagataaaacatggagcaggatcttcaaaacagaaggaaattgatttttccccttacacgatcgatacgcagaattttccgtacaatgtctggcggaaactgcataaaaatgtcctgcttgatgacagggaagaaattcttttgtcgggagatggacagggagatcacgaactgcgcatggcaattgcagattatcttcatcaggcaagaggtgtgaattgtgtcgcagaacagatcataatcggcgcaggtaatgaatatttagaacttctgcttgcgcaggtgttaggagaaaagaagaccgtattgatggatgatccgacttatctgcaggcgtaccgtactttttccaatataggttatctggtgaaaaatattccggcagagcaggggagtatgccgatcgaggcggtgcgcagggaaaacgcagatatcttatatgttatgccgtcacaccagtttcctttgggaacagtcatgcctttaaaacagcggctggaccttttaaaatgggcatcggagaaagaaggcagatatctgatcgaggatgatcatgacagtgagtaccgttataaaggaaagccgatcccgtcactgcagagtatcgatcacgaggaaaaggtgatatatctgggtactttttcaaaaagtattgcgccgtccctgcgaatcagctacatggttcttccgttgcatttgttaaaaaaatatcaggaatcatgcagcttctattccacaaccgtttcgaagattcagcaggaagtattgcgggaattcatccggggaggatactttggcagacatttaaataaaatgcgtggaatttataaaaacaagcatgattttttagtcggcgaattgaagaaaaaaaactgggtggagaatattgcaggggataacgcaggactgcatgtgcttgtgcaggtgaatacaacgcttacagaggaagaaatctgtaaaaaagccgcagagtgcggaatccgccttatgggtatcagagagcattatattcacacaccgccggagggaagaccggtactcttgttaggatatggaaaaccggacgaacaggaaatacaaaaagggctggaagtgcttgaaagcattataaccggaagaaacagtaacaactgtaaaaaaccataaaagaacaactgatgaattatctactggatggccggtgtgaaatctcgaacaaccatgctgaacgaaaagccaaaagctatgcaatcggacggaaagccttcctgttccacacatcagaagccggtgccggagcaagtgcggtgatgtgcagtatcgtggaaacagcaaaagcaaacaatctgaatattttccagtacctctatacggtactcctgtatatgccggattacatgaattcgtccgcaggtatagagcagctgatgccatggagtgactttataaaggaaaaatgttcagggctgattaacgtggaatctaatgttccggaaaatagaattcccctgccacttaggtagcagaggaattgataataaatgttaatcgtttcctgttttaacagaatttagcaaaagggtagacggcgtgttattcatcgcttacaaagaagggaagaaaaattggaagacttctattttaatagaaaacaaaaagtgaaataccgtttgtcagatagaaattcctgacagccggtattttgatttgcaaaggattatatgtgttgatgaaggaattaagtattaattagtgcgtattacttaaaacaacattgcagttaaattcggtttgcgagtagctgatttttaagaaaccttcatatttcttaacactattttcaacattgtaaagaccagttccatagtctttagaagagaatgttccgcattttgtgtatgaattgcaactatttttgacgttgattataacaaagttattatgggaactaattattactgatacttctttattggttttgcaaagagcactagcagataaggcgttttcaagcaaatttgaaaatatagttgtgatgtcaatgtcatccataaatctaaaatcagtttgttcaacggtacatttatacagaatgccgtgttgttctgcaaaaatctttttttcgttcagtataagatttagaactgtattattgctgtatgggaataatacaaaatctgatataagtctatccattcctttgatatagttatctgctttttcaaattcattgcttttatatagttgctctatcgtattaacatgcttatctatgtcatgtatcatttgtaacgatttctgatagtttgcgtctaattgtttataatatttaagttgtaagtttgcttgctgctctgatcgggctattttagactttaatttttgattttcaataatgtattcaagtagccacataatatgaagattaataaatacggtaattataattgttaaatatcctatatatttgtcagtctccggtattgtaacagaataacctattttagcgtttaagcaaatgtttactatactacagaatgataataaaatatataaaatcaattgtttcataggaagtacactatgctgttttgataaataacgattcttggttacctggtataaacatataattaataattttgaaatagccattttaaaaacggaatgtgctggttcgcataatggaaacttaataaaaatcaaaaacaattcatatagagcgacccctattgtttcaaaaaaagttaaaagaaatatgaaaaagtataaatccaggagtaaagttttctttgaactccatggatcataaaatagtaagcatataacaggtgtaagaatgacaatccaacttgcaaaatttaaaatagggtaattaaaaagatttataattccaattaagactccgacggaaatggtaactatattataaatccatttttgtgaatatatagagttaaaatttattttaaaatgatcaaaaattagttgtgcagaaacataacaattaattacagaaacaaagtaaatgatataagtattcataaatgcatctccctttatagtattaacattttttctaaataattgtttagagcatttttgaatagtacggcacgtttttgagacaaaggaatccttatcccattggtcattaataattcgtagttttttatatcttttacatattttaaattaactacaaaactttgatgtggcataaaaaagttataactcgccatgtcaatatctatatttccgattttttcattaaaatgataatcaccgcttttactgcatatcttgacatatcgtttctttatatattcaaaaaaatatatatcatctatattaaattcggtcaatccttgctcataagttatgaaacgcgcaatataaaggggatcattattttgtgattcataaataagaatgtcattaagttgtttataaatgattttttttgaaattggcttagtaaggaatgcaaaagaatgtacattattatgtgccgtttcatgatattgtttataattcgtaatataaattatatatgtaaatgcattcaattttcggagctgagtacctatatctatgccgttttctgtttgtaaaataatgtccaagaagataacgttatattttagtgatgattctaacaattttttgccggaatcatataaatcaacggatatggatatattattttcggtggcaaattcttctatgcatttttgaattgaactgagtacaatcttgtcatcatcacaaatagcaacagtaaacattttttacctcttttattatatttgtagtaggaagcaactaatctgatacaaattataacatatatcgtgagaatacactatgaaatagttgtgtatgttagggcgaaaaactgtatatcggggcatacttattgtttttattcaaaactcttttataatataaaaaaaattttttgaggaggatttgtatgaaaataaaagggttattaataattgtaatatgtatgataggtctattgggatgtacttcaaaaggatttgatattgaaagagtatatcaatttgttgagatacagtcatcaaatggtaaagagataggaactatagtgaattcggatgatttagaatttttttttgaggaaatgaaatttcaagaatggaaatatattgaagaaaaagaagattttggtaaatgtatttacaaatttatagcttatgaatttgtaaaagatgatgaagagtactatattagggaagacccatatgagttatataaagtagatgacaactattatattattcaagatagtgatgttatttccattccaaaaagcgcggggcaatttttgaattcaattgaaaataaaattacaataactcaacctatatcagaagatattctggataattgggaaaatagaattgtcaataatacggatagtagttatggaacaaagaaaaaaacatataatgatgaaacaattgtttctaaaatcactaaaatagttataagtgatgaagatgaattagatataaaaatagataacaaggaagagataacggcattcattgaaggcttagatacagatagttggagttcaatagatgatataccaaacgatgcgattttaaggcgtaatatatcagcatattcgtttaggagaagaactaaagaaaaggttttgaccacaatgtatacgattatgttatatgaagcatctaataatgaatattttataagtgagactattccagataatggtacacaggacggagattatattgaatattatactattcccaaaagcgtagcagattttattttacaaactgaataatagataagcgtttaaaaaaggagatagccgttgtggctatctccttttattgttagggcaaggccctgtttccaggatggagtttttcgtgttccgaaaaatggaatgctggaaacaaataaaccacttgctatgcgagtggttggaaatgctttagcttacagaaaaaacctccaatgctataataatgcaggttcgccaaccgcattacaagcagaggaggtatccatatggatataaatagtttagcacacacgaaatggaattgtaagtatcacattgttatttgcaccaaagtatcgcagaaaactaatatatggacagttaaaacgtgatatagctaatatattaagcatgttatgtaaaagaaaaggtgcaaaaattgtcgaagcagaagtatgcccggatcacatacatatgttagtagagattccaccaagcataagtgtgtcaggtttcgtagggtatttaaaaggaaaaagtacgctaatgatatttgaaagacatgcgaatttaaaatataagtatggaaacaggcatttctggtgcagaggatattacgtagatacagtaggcaaaaatgcaaagaaaatacaggaatatattcaaaatcagttaaaagaagatttggaatatgatcaaatgactctgaaagagtatattgacccgttcacgggtgagccagtaaaaacaaacagacagaataagcccaaggggcttagtaggtaaatgacgttgcggctggcgaaccattcgatgagtctttagactccagagccggtaataagcccttatagggcgtgagcaaaccaacggctaagccggtggttatgattacccaccagcaaggacgagggcactgaaaaagtagattataccgtctatatttggtacaatgtatctatcaaatataggcggtgtttttatgatcgaacaacagcagaaattgatgctaagtccatacatggaaatatatgaattagtaatcccgaaagataatcttctccggcagataaaagaattggttgattttaactttatttatgatgaattgcttgctaattattgtctggataacggacgaaatgcagttccacctatccgaatgtttaaatatcttcttttaaaatcaatttatgatttatcagatgttgatgtggttgaacgttctaaatacgatatgtcttttaaatatttttttggacatggctccagaagatgaagttataaatccaagttcattgacaaaatttcggaagctgcgtttaaaggatatgaatcttttggatatgctgattgccaaaacagttcagttagcattagaaaaaggaattattaagtcaaaatccattattgtggatgctacgcatacaaaatcaagatacaatcaaaagactccccgtcaagtactccaggaacaatcaaaaaaactgcgccgtagcatctatgagattgatgaaacaatgaaagaaaaatttcctgataaaaacacagaggattctttagaaaaagaactaaaatactgtaaacagcttattgatgttgtaaaaggaaatgaagaaatttgcagttatccaaaagtgcaggaaaaattaaatctactagaagaatctgtcactgatgacatggaacatttagaaacttcaaaggatgaagatgcaaaaactggtcataagacagccgacacttcattttttggatataaaacacacatagcaatgacagaagaacggatcatcacagctgccacaatcaccagcggcgaaaaaacagatggcaaagaactgccaaaacttgtacaaaaaagtaaagctgctgggatacagattgaatcagtcattggagatatggcttattctgaaaagaaaaatatcgaggcagcaaaagaaggtgattatgaactgatagcaaaactaaatccaattattacacaagataaccgaagaaaggaagatgagtttgaatttaataaagatgccggaatgtatcagtgtaaagccggacatttagccattcataaatatttcgataaaaggaaaaaagataaaaaaaacaaaaacccacgtatggtctattttttcgatattgaaaaatgtaaatgttgtccttatcgtggtggctgttataaagaaggagccaaaaagaaaacatacacagaaacaatcatttgcgattcccacagtgaacaggttaaatttcaggaaactgagcatttcaaagaaaaaatgcgggaacgctataaaatagaagctaagaacagcgaactaaaacatcggcatggttatgacgtagcgtcatcatcaggtcttatttgtatggaaatgcaaggagcaatgacgatctttgcagtaaatcttaagagaataattaaattaatgaatgaaaaataagaactttggccgaaaaagacaagcaatttatattttgtctaacagaaaatccaccagaatcataaaaactctgatggattttttcttttttattaaagtcaaaataaaaatggtatgtttttcagtgccctctctgaataatggcagagggcggcagcattttgtgctgtcgccctcttgattaccgaacagcaaagacgggcggggctgtcaacggcggcgcatttgcgccgttcatcttgaccgttgacaggctcggctgggtttgctacaaattctatctctttatgatttgtcggaaaaacttcttacccaaacaaaaactacaatcgcggttgcaatgagtaattccgcaagaattacagaagcattccatatttcaaaatagaaatgcccaatgaaatagaccgcaaaaaaaatcaaataaattccaatcgaatacataatatttttggaaatttgagtgcgtttctgttccctaactaacatctgtttctgttgttgttccagaatttctgttttaaccgataattcatctatctctgatggttttaacagataatccacggtaacatcgaatactttgcttagttcaacaatcttttctacttcgggtatgacctgcccactttcccattttgaaatagattgtcttgaaacattaagctgctcagccagttgttcctgtgttaattctctacttttgcgtagtgttataagtttttctgcgaactccatatgtgttcctccttttgattttgtgtataaatcttatcaaaatactcatttgcactctagcaagtaagctatacaattacatgacaaacggtagagtttaagtgctttcttgtatatcttgattgtcattctactttatatgcctattttagcatagaaaaaacgttttctctattactccattattttacggaatagtgggctgtctttctttattttagttgtgttactttatcacacatgagcattatccgcggaaataaagaagaatattggataacacatagaaagaatgcttgtgaaatatggaaagatgggaaaacaacaacaggaatattaaaatacgtatacgatcaactaaatgacgatgacattgatatgtttgaagctatgccaatagaaatgacactaaaatatgatggattgccacgatttacaatctgccatggttctcctttcaaggtcaatcaaagcatgcgtccagactatgagtatattgataatttgcttgagaatatgccgagcaatctgataatatgtggtcactttcatattcagactgattatgttagaaacgatgttcgagtaatcaatcccggtgctgtaggagtggcgttacatagtaatagtttagctcaattcatgacacttactggaaaggacggacattgggaacctcagtttttttctgtaggctatgacgtagataaggttattgatgaaatggagaaagaacgattggattttaaagcccctggttggtttagaatgacaaaaaatctgttaactactggcgaaaaatcaatagttaactttatttcagaggtgcaacaagtttattacaaggagacagggatatcagattatagattaattccagaagcattttgggataaaaccctgactcgacttggaatataatgaataacagattccagtttttgaaactgaataataggaaactgcgaaatggtaagagaaatgcttcctcttgcagaaatatatgtgtatgaagatgactatacaggggaaaaagaatttgtaatggtgtggaggcgttaatttcccatttataaatatgtcctctgttttttgattaccttgacaataccaaaagcagatttcacaagttatcttcagtgtaaatgaaataaaaatggtacagacaaatacgatttcctttgtgagttctgcgaacaggaacatcatattttgtctgtaccatttttatttttaagatttagttattcttgttgttttctttctgcagctcaagcatcttcatagcacgaacttttaatggaagcccgaataatgtgatgaatccatctgcatcgtgatggtcatagagatcaccggttgtgaagcttgcgagggactcactgtagagagagtatggggaagtagttccggctttgatgatgtttcctttgtaaagcttgaattttacctcaccggtcacatattcctgtgtggactctacgaaagcctgtactgcctcacggagtggtgtgaaccattttccttcgtatacaatctgggcgagcttgttacccatatcttttttcacttccatggtagcgcggtcgagaacgagttcctctaactgctcatgagcttccatgaggatggttccaccaggagtctcataaacaccgcgggatttcatgccgacgacacggttctctacgatatcaataataccgataccatgttttccgccgagtgtatttaattcacggatgatatcagaaactttcattttctttccgttgacggaaacaggaacacccttttcaaatgtcattgtgacatattcgccttcgtccggagctttctcaggtggagtagtcaaaactaaaagatgttcgtaatttggctctaaggatggatcttccaactcaagaccttcatggctgatgtgccataagttgcggtcacggctgtagctggaatctacagagaatggaagatggatgccatgtgccgtacagaaatcgatctcatcctgacgggactgtaatttccagttgctgtcacgccatggagcgatgatttttaagtccggagcaagtgctttgatacttaactcgaaacggatctggtcgttaccttttccggtagcgccgtggcagatcgctgtagcgccttcttttcttgcaatctcaactaatttcttggcgattcccggacgggccatggaagtacctaataaatatttgttttcgtatacagcgtttgcctgtacgcatggaacaatgtaatcatcacagaattcatctacgatgtcctcaatgtataatttggaagcaccgcttaatttggctctttcgtcaagtccgtttaattcttcttcctgtccgcagtctacgcagcagcagataacttcataaccataagtttcttttaaccatgggataatggctgtggtatcaagaccaccggagtacgctaaaataactttttctttcatgagagtgaatcctttctgtcgtatattctttttatcatgtaaaccgttctttcatgtatgacaatgagtctgccacgaaacgatttcttctgaaacctaatatatactatgtggacaggaaatgcaagtgaaaaaatatacataatttaataataaaaatgcataaaagtatgcaataacaacagaggtttatacagggatatttatataaattaaggtaagaaaattgtaaaaccaagaaaaataagaaaaaaatactaaaaatagtgttgcataaaaataataatgaatgtataattatgcaatagcgattgaaaaccgggaaacaaaaaatactttactatcctaaagagctgtactatgatagaaacgaattagagtggtaaagtgtaaaaagagaaaacccttcggggagattggagaatagattatggtaaaagttgggattattggagcgactggctatgcaggaaacgagcttgtccggttattgatgggacacaaagatgtggagatcatgtggtacggttccagaagctacatagataagaaatatgcagaagtttatcagaatatgtttgaaatcgtagaggatacctgtctcgatgataatatggaagaacttgcttccaaggtggacgtgatctttaccgcaacgccacagggatttctggcaggtgtcctgacagaggaaatcttatccagagtaaaaattatcgatctgagtgcggatttccgtataaaagatgtcagaacttatgagaaatggtacaagatcgaacacaggagcccacaattcattgaggaagctgtgtatggactctgtgaactcaaccgtgacaagataaaaggcgcaagactgatcgcaaacccgggatgctacacaacctgttccattttaacagcatatccactggtaaaagagggactgatcgatcctgacaccatgatcattgatgcaaaatcaggaacatccggagccggaagaggtgcaaaacttcctaatctgttttgcgaggtgaatgagaatatgaaagcttacggcgtgacgaatcacagacacacaccggagatcgaagaacagctcggctatgcggcaggaaaaaagatcgtggtcaattttaccccacatctcgtaccgatgaaccgcggtatccttgcaacagaatatgcaacgttaaataagaaagcagacggcacgcttccaacatacgaggaagtgaaagctgtttacgataaatattataagaacgaaaaatttgtccgtgtactggaaaaagatatctgcccggaaacaaaatgggtagagggaagcaattacgtggatgtgaacttcaaaattgatgagagaaccggaagaatcgtcatgatgggagcactcgataaccttgtaaaaggtgcagccggtcaggcagtgcagaacatgaacctcttattcggcttcgatgaggcggaaggattaaatcttgttccgatgttcccgtaagaggctgcgaagcagctattcggtcaggatgcacagcatgagaagccgttttatagaaaactgccccggagaggcagacagcaaggaagatgaaaataacatgaatgatacaaatttaacaatccgtcccatgacaatagatgattttgagcaggtgcacagcctctggatggagatccacggcttcggtatccgcagcatcgatgattcgaaagagggtgtggagcgttttatccgaagaaatccgactacgagcatggtggcagtgtgtgatggaaaaatcgtcggcgcgatcctctgcgggcatgacggcagaagagcaggactttatcatgtctgtgtacaggaaaattacagaaaacacggaatcgggcagaaactcgtggagcggtgtctcgaagcattgaaagcagaaaaaatttccaaagtcaatctgatcgccttcaagcagaacgagattggcaaccgcttctggcagagcctcggctggaaatactgcgacaacgtgaattattatgagtatgtattgaatgaagagaatattaccgtgtttaatccgtagaaagaattaatatagacaattgcctaaataacgaattagataattgcgaaactctaattcagattatgaagattgtgaagaattaacaaaagtttcgaagacacgctctcgctacgtgtcgctcgcaacggtactagcatgccagccacagcaaatgctatgtctgccaagcaagaaccggcggctccccagtgtcttctcaaccttttgtcaatttttcacaatttaatctactgtatctatgagtttcgcaattgtctaaataacgaataattataaggagataaatcatgaaacagatcacaggcggtgtgaccgcagcaaaaggttttcaggcagcaagtacagcagcaggaatcaaatacaaagacagaaaagatatggcaatgatctacagtgaagttccatgtaaggcagcaggaacttttacgaccaatatcgtaaaggcggctccggtcaaatgggatcacaatgtcgtatacaacagcaaagcagcacaggcggttgtcatcaatgcaggaattgccaatgcctgcaccggagaggaaggcatgggctactgcaggcagacagctgagaaagtagaaaaagtattaggcattgcagcagacgaggtgttggttgcatctaccggagttatcggcatgcagctcccgatcgaccgtatctgtaacgggatcgatgccatggtgccactgttaaaaggagataccgggagcggaactgaggcttccaaagcgatcatgaccacagacacaaaaaacaaagaggtggctgtgaccatcgagcttggtggaaaaacggtaacgatcggaggcatgtgcaaaggctccggcatgatccatccaaacatgtgtacgatgcttagctttgtcacaacagatgcggcaatctccaaagaattattgcaggaggcactgagcgctgatgtgcaggacacctacaatatgatttctgttgacggtgacacttccacgaatgatacctgcctgttacttgcaaacgggctggcagaaaacccggagatcacagagaaaaatgcagattatgaggaattctgcaaggcactgaactttgtcaatgagacgctggcaaagaaaatggcaggcgacggcgagggtgcgaccgcattatttgaagtgaagatcattggtgcagagagcaaagaacaggcgaaagttttaagcaagtctgtcatcacctcaagtctcaccaaagcagcgatttacggacatgacgcaaactggggacggatcctctgcgctatgggttattccggtgcagcgtttgacccggaaaaagtcgatttgttctttgagagtgccgcaggaaaaatgcagatcatcaaaaacggtgttgccgtggattacagcgaggaggaggcaaccagaatcctgtccgaacctgccgttactgcgatcgcagatgtcaaaatgggcaatgcatccgctaccgcatggggctgtgacctgacctatgactatgtaaaaatcaatgcggattaccgttcataacagggggatggaaaaatggaagaaaaaaacatgaacgaacttttgaaaaaagcggaggtgctgatcgaggcactcccatatatccagcgttttaaccgtaagatcatcgttgtcaaatacggcggaagtgcaatggtggacgaggaattaaagcagcacgtcattcaggatgtcactttattaaaactggtaggtttcaagccgatcattgtacacggcggcggcaaagagatcagcagatgggtagagaaagccggcatgaaaccggagtttgtcaacggactgcgcaagacagacgaggcaacgatggaaattgcggagatggtattaaataaagtgaacaaatctcttgtaaaactggtgcaggagctgggtgtaaatgctgtcggcatcagcggaaaagacggcggaatgttaaaagtggagaaaaaatattccaacggacaggatatcggttatgtcggcgagatcacacaggtcaacccacagattttatatgatcttctggaaaaagattttcttccaatcgtctgtccaatcggcatggatgaaaactatgacagctacaacatcaatgcagatgatgcagcctgtgcgattgcgagagcagtccacgcagaaaaattagctttcttaactgatattgagggtgtatacaaagatccgaaagatccgtccacactgatctcggaactgccgatctcagaggcgaaaaaactgatcgaagacggatacatcggcggcggaatgcttccgaaattaaacaactgtattgatgcaatcgaaaacggagtttccagagtgcatattttagatggacgtatcgcacactgcctgctgttggagatctttacaaacagaggaatcggaactgcaatcttaggggataaggagacaaagtattatcatgaataaacaggattacattgatggagcagagagtgcgctccttcatacatataatcgtttctcactggtcattgatcatggggatggtgtgtacctttatgatacagacggaaaagagtatctggattttgcagcaggaatcgccgtgcaggcatttggctacaacaacaaagagtataacgacgcactgaaagcgcagatcgataaagtgatgcacacatccaatctgtactataatgttccaatcatgaatgcggcaaaacgtttattaaaagcaagccggatggatcgtgttttctttaccaacagcggtacagaggcaatcgagggagcaatcaaggcagcgaagaaatatgcgtacaccagggacggacatgcaggacatgagatcatcgcaatgaaccattcttttcatggaagaagtatcggggcattgtctgtgacaggcaataaacattatcaggaaccgtttgaaccactgcttcccggagtaaaatttgcagattttaatgaccttgacagcgtaaaagctttgattaatgacaaaacctgtgctattatttttgagacagtacaaggtgaaggtggaatttatcctgcaacagaagcatttataaagggtgtgcgtgcgctttgcgatgagcatgacatacttctgatcttagatgaaatccagtgcggcatgggaagaaccggagaaatgtttgcatggcagcattacggtgtgaaaccggatattatgacaagcgccaaggcgcttggctgtggtgtcccggtcggcgctttccttatgacagagagagtcgcagagaaatctctggcaccgggagatcacggtacgacctatggaggcaatccatttgtgggagccgctgtagataaagtacttgagatgatggagcgcgaccatatcacagagcatgtgaaaaaggtcgcaccgtatctggagaaaaaattagatgaactggttgcaaagtatgatttcctgaccgagcgaagaggtatgggactcatgcagggtgttgtctgtgaaaaaccggtaggccagattgcagcaaaagcattggaggcaggactgatcgtgatcacagcaggttcgaatgtacttcgttttgtaccgccacttatcattgaagaaaaagatgtggatgagatgatatccaggctggagagtattttataatgaaagtagtacagaagagaatgatcgcagcgggctgtatcggcgtgctggtgatcggaggtgccgttgttgtatccagacacagcacttatgaacagaaagaaaatgaaacggaaaatggaacagagacagcatcagttagcagggtggtaaaacagcctgctgatttgatgttctggtatagcgataaaagctatcagaagttttttgagaaggcggcagaagaatattatgaggataccggtattgttgtggatgtagagtatcaggacagcatggattacatggatgcagtatacacggcaacgatgcagggagaaacatttccggatatttacatgatcggaagcgatgagttagaggaagcatatctttacggacttgcagcagaaaacacggcatctgatatttatgagagcaccgtggcgtcgaatgcagtgacagcgtccacttacaaagagaaaatgtatgcgtatccattaagttataatacctgtctgtttgtctataaaaatggttattttgagacagaaccggagacattgcaggcaatcattgattattccatcgacaatgagccaccggaaaatgtgcagtatctgttagagtgggatgtgaatgatgcgttttatgattttccatttatatcgaacagtgtcagctttgtaaaagatgaagtggaaacgatgcaggtgaattatgatgaggatctgtataacgaagatctggagttcttttcacagagtctggagtcgttttccattgatgcttcgacggttacggaagcgagtgtgatctcagattttaatgatggaaaaacactctgtgcaatcattgattcagattctgttgccggtctcacaggaactgattatgagatccgggagcttctggcattgaatgacacgttgcagacatcttccgcagcgttgacagatcttgtggttgtgaatgatttctcggagaaaaaggaaaaagcggctgattttgcagagtatgtaacacttaccatgtcaggagaacttcatggacttggcggtcattattccgtaaaattatcggaggacgcagacgagaaggaacagattgcctatcaggcatacgaaaatgcgatcccggtaccggattcacaggatgcaaaagaattttgggtaacattaaaagaaacaatatctcaatatttttaaaaaaatggatataatatatttaatagtcttgtcatatttgtaaaatttcgttaaaatatatacatcaggcgttgagggctctttcatccatctgtgatgatgcattcggtggagaaggagaatgctatgaatcgaaagaggaaagtattcctggtaatcatattctgcatgggagtgctctgtggatgtggttccaggaataatgtgtatttggagaaaatacagacagagacaagtgaagttccgcagacagaggagaaagactgccaggaagagatgggcagttgtatggtgtatgtttgcggggcagtagaaaatccgggagtgtatgagctgccggagaacagccgtgtttatgaagcagtagcgatggctggcgggatgacagaggatgccgggatggaagcggtaaatcaggcagagtttgtcacggacggacagatgttaagaattccgaccatggaagaagtggcggctgcacaggaagaatccgagagcaatgtggatgatggcttactggacattaaccgggcaagtgttgcagattttatgacgcttccgggaatcgggcagtcaaaagcagaggcattgtttcagtaccgggaagcacacggcagattttcttctgttgaggagatcatgaatgtggatggaatcaaagaaggagtttttaacaaaataaaggatagtataaaggtgtaaaaatggcaaaaaaggttcttgttgttgatgatgaaaaattgatcgtaaaaggtatccgtttcagtttagagcaggatggaatggaagtggactgtgcatatgacggggaagaggcactgaaaatggcaacagagaatcattatgatatgattcttttggatatcatgcttccgaagatggatggatttgaagtatgccagcacatccgcgaattctctgatatgccaatcgtgatgctgactgcaaaaggcgatgacatggataagatcctcggtctggaatacggagcagatgattatatcacaaagccgttcaacatcctggaagtcaaagcaagaatcaaggcaattatgcggagaaccgcaggaagccagccgaagaaagaggattccaaggtcattgaagcgggtgatcttcgtctggattgcgagagcagaagattgtttatcctgaataaagaagtgaatctgactgcaaaagagtttgatctcttagaacttttggtcaataatccgaataaagtatacagcagggagaatctgctcaatcttgtatggggttacgagtatccgggggatgtcagaactgtggatgtgcatgtcagacgtctcagagagaagatcgaaaagaatccaagcgagccaaagtatgttcataccaagtggggtgtgggatactactattaccagaattagtcagggtgcgaaagaatgtccagatttaaaaatgttattaatttttttaaaagtctgaaattcagactgatacttttcttaatcctttttggaattgtaccgggaatcgttttaaaagttggaattgtaaagacatatgaggaccggtctgtttcaatcaagacaagtgagatcttaagccaggcaaaaatcctggcgaatcagattgtttccaatgattatctgaattatccaaactcaacgattatcaatgcagaattagatcagttatcgaatatttatgatggccgtgtcatggtgatcgataatgagtttcacattatcaaggatacgtatgatcttgacacgaataagacgatcatttccaaagaggtaattgagagttattacggccaggagatcaaaaaatatgacgcggaaaaccgctatattgaactgaccgttccattgagcagaccggtggaacagaccggggcaacagaggttttaggtgttatgttagtcagtgtgtcgacggacagcattaacctcaatatggagtatctggcgagaaacgcctatgtgatccagttgatctgtgctgtggcggcagttttccttgcagtgatcttaagtatccagttggtaaagcctttccataagatgtcaaagtctatcgatgagatcaaaaccggatatggggaagatgcgctgtctgtgaatgattacacggaaacaattgaaatctgtaaaaagtttaatgagatgttaggcagaatgaaagtgctggatgattccagacaggaatttgtatccaatgtgtctcatgagttaaaaacaccgctgacatccatgaaagttctggcagattctcttaacagcatggaagatgcgccaatcgaactttacaaagagtttatgggcgatatcggaaatgagatcgaccgtgagacgaagatcatcaacgaccttctatctctggtgaaaatggataaatccgcggcagacttaaatgttaccaatatgaacatcaatgagctgctggagcagattttgaagcggttaaacccgattgcggagaaacagaatgtggaacttgtgttagaaagcttccgcccggtgtccgcggatgtggatgaggtgaagatcacacttgcatttacgaatctgatcgagaatgcgatcaaatataataaaccgggtggatgggtgcatgtcacactgaacgcggatcaccagtatttctatctgaaggttgaggattcgggtatcggtattccggaggactccttagagcatatttatgaacgtttttaccgcgtggacaagtcccactcaagagagatcggtggaaccggtcttggacttgcgatcacccgcaatgcagtgctgatgcaccgcggtgcgatcaaagtgttcagtacagagggagagggaaccattttcaatgtccgtattcctttgaattacatcgcgtagtgcgatatgtgacagcagatttttggtaatggagcaaaaaagtaatgagaaaaaaaatagtctttcttctggcatttctgtgcatacttttactggcggggtgctcgaatggaaaagagacaagtaaatacaacatcgaatatctgaataaagataaaaccgggattgccgagatgccttatgatgcgtccgcaacaacgacagatgcgttgatcgaagaattttttgcagccttaagttctgatccggataatgtggaataccgtaaaccgatcccaaatgatgtggagatcacaaagtattcgctggacggagcacttctcactatctattttgatgtagattatctgaatatgaaagaagtggaagaggttttgtgcagggcggcagtggtacgcacgatgacacagatttccgggatcgactgtgtgtccttttatgtggatgaaaagccgctgacggacgtgaacggtaaaatggtcggaacgatgtacgcagaaagttttgtggagaatcccggagaacagatcaatacgatccagaatacgaatctcacactttatttttccaatcaggcgggagacggactcgtgaaagagacaagacgggttcactatagcagtaatatctcattggaaaaactgatcatggagcagcttctcgaagggccggaatcgaagaatgccaggtctgcaattccttcgggaaccaaattaatgagcgtatcgcttgtggatggggtatgctatgtcagctttgatgagaactttaagaatcaggattattcagtgaatgaagccattgtgatttattctattgtggattcattgtcagagttatcctccatcagtaaagtgcagatttccgtgaatggcgataccagcggtgtatatcgggatagtttcaaacttgcagatatgtatgacaggaatctggattatatcgccaaaacagcgaaaacggatacagaggttgtagaggagacagaaacggaggaacagtaattattgtttaaacggccattatgtgaaatggcatctggattgattcttggaattttgtttatgaggtatcaaaaatggtatctggcagcagttgctgccggaatactgtttggaattgtatggaatttatggcacaatacgatccgtaacagtagtgagaaagacagtatggcaaatgccagagcgtggatatacccggtcttccgtgtgggatgttttcttatattctttttggcaggggcatttcattatgcacagaatgaatcatttcgtgacgcatacatgatgaaactacaggatggaatgaatgtgactgtgcagggaaaactatgcagcaaacagttaaaaaacggacaatattcctattatttagatcattgttatctatctatcgggcaggagatactgccatgcaatcaaattcttttttatcagacttccgatgatgattccatcgggcaaacccttattgtaacaggaacggttgaattgtggaaaagtgcatccaatgatggtaattttgacgcaaaagcattttatgaatccaaaaagatcgattttcaactgaaggaagctattgtgaaaaatgtttacggagcagaggatggattcggggagaaaatttacaggctgcgccggaagataagcggtgtatacgaaagctgtatgagcacatcagatgctggtgtgctttccacgatgacgctcggagagaaaaatcttctggacgcagaggtgaagcagatgtatcagaaagcaggaatttcccatgtgctggcgatttccggactgcatatttctgtgattgggatgggactttataaattgcttcggaaaataaaatgctcttttttgacttccggtgttattgcaggcacggtcatcggcggctatgggatgatgtctggacttgggacatcgaccatacgcgcggtgctcatgtttttcgttttattgttcggacagtggattggaaggagttatgatacgctgtctgctctgggactgtccgccattgtgattttatcggacaacccttatctgctctggtatgcaggatttttgctgtcatttgcagcggtgcttggaattgtggctgtgggacagacactgatcaaaataaaaaagccgttctttactttttcggagaactttctggtgagttttgcaattcagcttgcaacggtgccgcttacggcttatttcttttatgaggtgtcggtctggtcaatgcttatcaatttttttgtactgccaatcattgggatactgcttttcctggggcttcttggcggagggattggtttattgtctgtccgcgtggcaggggttctttttgtgccatgtcattggattttactgttttatgaaaaagtgtgtagattcagtgcaagattaccgggggctgcctggatcacggggcagccggattggcagaaactgttgcttttttatctgatattgggagccgtgcttttcgcaatgaaaaagatgaagcgacggcgtggatttgttttcataggttgttttatgctgcttgcagtattgcataacccggtgaagggatttgagcttgatgtgctggatgtggggcagggggatgggatttatcttcacacgaaagaggggacaaatttcttttttgacggtggcagtacggatgtgagtaaagttggaacatatcggatgcttccattcctgaaagcaaagggtgtgaaaaaaatagattactggattgtttcgcacacagacgcagaccatatttcagggttaaaggagatcctgcaggcagagtatgagatcgatcatattgtgttttcgaaatatgtattaaatgacgaggcctatcaggaacttttggcattggcgcaaacgtatggaacagaaattttgaaaatggactgcggtgacacgctcaccgatggtgaagcggggctgcgctgtattttcccggacaaaacttataaaagtgatgataagaatgcactgtcccttgtgctgcgctatgaagatcaggagttttccggtatttttaccggggacatcagcagcgcagaagaacagtatcttgtggaacacaaaaaggctggcagcgtcacattttacaaggcggcgcatcacggctcgagatattccaacagtcgggatttcctaatggcactctcaccggagatcacaaccatttcctgtggggaaaacaaccgctatgggcatccgggtgaggaggctttgtgcaatataaaggagagcggaagtgcagtctatgagacaatggagtgcggacgtatccgcatccgtatggaaaatggaaaacctgtggtggaaaaattccttgaaggaagatgaattgttctatataatagggaaagagtttatagataattgcgaaactcatgagaacgtaaattgaattgtgaaaaattaacaaaagcttgagaaaacactggggagcggtcggttcttagaaggcaggtgcgatggcaatcgtgactggcttcttagtaccgttaccagcgacacgtagcgagagcgtgttttcgaaaattttgttaattttgaacaatttaaagaaagataggaggttcgcaattatctaaaagagtttaaaagcaaaggagaaacatatgttagtatgtgactatattgtagaacaaattgatggtgactatgcacatttaagaagggtagacgagccggacggcgagctgaaactggtggcaagagcgctgctcccaatggagatcacagagggaagcaaattacattatgaactgatgcagtacactttgattggataacaggtgacaatgaaaacgattgacgaagatattaagagtggacaatttaaaaagatatatctgctctacggcgacgaggcgtacctgaaaaaacagtacaaagacaagctgaaaaaagcgttggtgcagccggatgatacgatgaattttactgcgtatgagggaaaagacacaaatccgaaagaggtgatcgacctgtcggaaacccttcctttttttgccgaccggagagtgatcctgattgaaaacagcggcttttttaagggcagttgtgaggagctggcagagtatatgccgcaggttccggatacgacactgtttctttttgtggaggaggaagtggacaagcgctcgaagctctataaggcagtgaaaaatgtaggaaagatcgtggagtttacaacacagacagaggaacttctgacacgctggatcttgacacgtctgaaaaaagaggggaagaatatcacaggttctgtcatgcagctttttttgagcaaaaccggaacggatatgggcaatattgaccgcgagctggaaaaattgatctgttactgtatggataaggatgtcatcgaggcgaaggacgtggaggcagtgacgacagagcagaccacaaataaaatttttgagatggtcaatgcgatcgcggagcataatcagaagaaagcgctggatctgtattatgacctgctgacattaaaagaaccgtccatgcggattatgtatctgatctccagacagtttcagattctgttgaatgtcaaggatatgtcgcaaaagggatttgataacaatacgatggcacagaaagcaggaatcccgccgtttgcagtacggagaaatgtgacgcaggcaaaaggatttacgatgcagcagttaaagcaggcaatccgggatggcgtggattttgaggaagcggtaaagaccggccgaatgaacgaccagatggcagtggaactctttttaatgaaatacagcaaacaatagaatgcacgctttgcgtgcattctattgtataaaaaaatcaccagtatgacggtactggtgatttttgaattcgcgaattttaatttatcttctattaagccattgcgttaacaagctttgttaaacgggaaacttttctagcagaattgtttttgtgataaacacctttagaagcagcgctctcgatagtagaaattgcaactgttaatgcagcttttgcagcttccttatcgtttgcagcaacagcagcctcaactttcttggttactgttttcacttcagatctgatagatttgtttctagcagcttttgtttcagttactaaaattctcttctttgcagatttaatgttagccaatctgtacacctccaatttttttatgattgtaattgttcatgattgttacattaaagccggacacggacagttcaatgtaaacatactagagtagtataggacatttctataatgctgtcaatatataaaatgacattttttgcaaattttttgaatacctttttctaaatttcaaggcgatctgaaggtgagggcaaattcctaaaaagctgtggataaattttttgggcagggacatactaagtaaaatgagcgggaactcgttacagaaagagataagttgggaacagtaacgaaaatccacagaatgagaaagaggagaagcgcatatgtaccagatcagaacagaccttgcattagagacgcaggaaaaaatgcaggaagataaagtggaactgaaaggcgtccgtttttcggaggagcatgtcagtaaaaatctgaccatcagcacagtggtgatcgagacggagaatggtgcaaaagccatggagaaaccaaaaggtacttatatcacgatcgaggcattaaatatggatgaggaggacgaagattatcacagagagatctcggagcagcttgccaaagtgttaaagcagttgatcagcgtaaaaaaagaggatgtctccgtactgatcgtcgggcttggaaaccgggcagtaacgccggatgcattgggaccaagagtggtggataatctctacattacgagacatattatcaatgaatacggaaaatatgcgtttggaaaagagcatgtcaatcgcgtgagcagtattgttccgggtgtaatggcacagacaggcatggaatctatggagatcgtgaatggaattgtgaaggagacaaaaccggatgttgtgattgcaattgatgcgcttgcagcaagaaataccaagcgtctcaatcggaccattcaggtgacggacaccgggatcaatccgggaagcggtgtcggtaatcacagacacgggttaaatgagaaaagcattggtgttccagttattgcaatcggggttccaacggttgttgacgctgccactatagtaaatgatacgatgtttaatctgatcacggcgatgaatcagagcagcgaacttaagacgcttggcaacactcttggagaactcaatgagacagagaaatatgaattgatccgggagctgttgtctccgaatctgaacaccatgtttgtgacaccaaaagatattgatgaatctgtcaaaagattaagttttactatatcagaggggttaaatatcgctttgatcgatcacaacatttttgcataatgaatggaaactggcataagttgtattatgtattttcatggttatagaagttatcaaaaaaaaagattgaaaaataaatatggaaaatatctgatgggaatgctggtagttacagcacttgtaacattttttgtacagcggcaggagctttggagtatcgggaaaaaagcagcagtaaaaatggcagggacggcagtggtggatgtgctggcaccggggcttcactatgaagagaaggaaaacggtaaccattttcttgccaaagtggagaaaatattatttccaattgcagattatacggttcagataaaatcctatgaaacggatgcagagagcacgctttcctatgagatgatccttgcgatggaagcgttggacgagaactacgtggatgagaacggacaggttgtgatgcaaaataatggggacacagataatgcacagaatacagaaagttcacagccggcagataacgcgcagagcaccgacaattcacaggcagctgcaaatgcacagaacccggacacctcgcaggaaacatccaactccgcagagcagacatctctcacagttgcaccgcccatagcagcaacacagaaagcagtcgaatattctctggataaattaaacgattttgattatcttgtgcagaatttttatcaggtggacagtactacaactgtaaaaagtgatcagttaaatgtggcagcactcaccggaaaaaatatgaaaatcgcacatgatgcgagtacgccacaaatcttaatttatcatacccattcgctggaagggtatgcggattctattccgggagaccgatcgactacggttgtgggcgttggggattatctgacagaattgctgacgcagcaatacggatacaatgtcatacacgacaccggggaatatgataccatccgtgataaagcgtattccaaagcagcaccggcattagagcagatactggcagacaacccgggcattgacgtggtcatagatctgcaccgggatggcgtgggggagaacacaaggcttgtcacgaatgtgaatggaacggatatggcaaaagtaatgttttttaacggattgagcagaacgaccaaactgggggatatcgcctatctgtacaatccatacatagcggataatctggcattctcatttcagatgcagcttgccgccgcagaatactatccgggatacacaagaaaaatctacctcaaaggctaccgtttcaacatgcattactgtccgaaaacgctgcttgtcgaggtcggggctcagactaataccgtgcaggaggcaaaaaacgccatggttccgctcgcagacatcctgaacaaagtactttccgaataactgaaagcattgtcccggctgtccggtctggcagtctgccgggttatattatttgtgtatgcatggaaaggaagcggggcgcagaatgaaactttcgtgaaaaattgcgtaaatttatcaatgtttcttttttgactgctggtttatgtacattcatcaatgaacagtccgcgcaatatgtccgtttcagacacacactcgttagctttctctagtgtgcgtaaatgccagaatcagcatcgtttattgcagggcaaaaatcaaaaggaaaaccgggtgatttttgccctgcttctctgctgatcttctggcatgtaacgcacacacgagaaacctaagacgagtgtgtgtcatgaaacggacatattgtgcggactgtccattgctgaatgaatataaacaatgagagcagtcaaaaaggaaacattgataaataagcaatttgaacaagtttcattctgcgccccgcttcctttccgtcatctcagttatgaaaatccggcagactgccagaccggatagccgggactgcgcttccacctatccggaaattacagattcaggtggtatttctgcatccagtagttgatctggatgaagtaggcgagcagctgcggtcctgccatgagctgtccgaaccacggctttccgtattcggtcggtgcctctaggaaggtttcgagtttttttgtgtcgatgaaggtcttgaccggtgcatccggctggtcaaggatgtgctgcatttctgcaatcagaagtttctcatagccgggatgataggttttcgggtaaggactctttttccggtgcagaagttccgccgggagcaggtctttgcaggcatcacggagcagagctttctcaacgccattctggtatttcatttcccacggaacattaaaaacgtactcaatgatgcggtggtcggcaaatggaacacgggcttctaaaccagagtacatacttgtgcggtccatgcggtcgagcagtgtctgcataaaccatttgatgttcagataagcgatattatagcgtttccgctcggtttccgtctcgtctgaaaggtgtggtgcctggtttaaagaagtctggtaacggtcgtgggagtaagcagccagatccagatcgtttatgaacgagtctttaagaaacagcgttcgcacagacatatccgcggaccacggaaagccatctctggataaaagatcttcccggtaaaaccacggatatccgccgaaaatctcatcggcacattcaccggtcagtgcgaccttattgtgtttttttacaagggaacagaagtagagcagtgaggagtccacgtctgtcatacccggaaaatcctttgcgtcgacggcatctctgagtgcggaaaagagcgtgttttcatcgcattccagatacgtgtggtttgtgtgatagtgatctaacatgatcctgacataaggaagatcacgctccggttgaaaggcgttggatttaaaataaatgtcattgtccttaaaatcaaaggaaaaagtatttaaggtttcaccgtgtttttccatgtaacggcaggcaatcgcggtgacaatgcttgagtcaatgccgccggacaaaaacgtgcacaccggaacatcggataccatctgtctggtcacggaatcgcgtagaagaaaagagacagtttccactgtctgttcataggaatcggtatgcggggcgcggaacagatcccagtaagtgtgatcggacatcgtatttttagaaaaaatgagataatgtccgggaagcacttcgtttacatcatcaaaaattccatttcccatggtccgggcaggtccgatcgcgagaacttcgcgcatgccatccatagaaaccctcggagtgaatcccggaaaacaaaaaagtgcctttggctcagaggcaaacaggagctgtccggatacaaacgagtaaaaaagcggtttgattcctacgcggtcacggtataagagaagttgttttttgttgtcatcccagatggcaaaggcaaaaattccatttagtttctggacaaaatcgacaccataatgcatataggcgtaaagaatgacttcagtgtccgtagtcgtcgaaaattcatagccggactgccgcaggtcacgggcgagttccccggtgttatataattcgccattgtatacaatcgcgtattcctttccgttcttttggcgtataatcggctgtttcccggtgacaatgtcgcggatacttaagcgcgcgtgggagagaccggccatatctgacagatagatcccggactcatcatttccacggtgcgcaagacattcgtgcatggaagtcagcacagatgcccatttttctttctgttgttgataatttcctttggcgttataaaaacctgcaattccacacatatatttttccttacattctgatcgcattctattttggtttagtttatgctaaggggatgaattcatgcatagaataaagaaaaaacggaaaaacgcatgaaggaaaactgtggaaagatagaaaatatattaaatctggcattggatgccacgcgggaggaacgggaaaagtccctgaatctggatgtaggatatgatgttgcagatgatagctgggaggtgatcgtaaaattttttggaacgacagaggaactgcggcagaagctgtcggagcgtttcccggaggaacaggctcagattggaatttataacctcacaaatgaatatgctattttaaggattccgcagctgttggtagagcttgtcgcatccatgcctgaaattgaatatatggagaaaccaaaacgactttttttttcggtggaaaacggaaaaagaagttcctgcatcaatccgctgcagaccgggcagggtacaagtccgacaagtaatctgacaggaaaagaggtgcttgtggcagtcattgactccggaattgactatgcgcatccggatttttgcaacagtgacggaacgacaagaattgctgtgctgtgggatcagacgcttgacacggtctacgagcgtgagacgattaatctggcgttaaggcaggagagtgagcaggagcggtacgcaatctgcccgagcagggatgcatccgggcatggtacgcatgttgcaggcattgcggcaggaaatggcagggcttccaatgggcggtaccgcggcgtggcatatgagagtgaactgatcgttgtgaaacttggtgtgccgagagagacttcgtttccgaaaacaacggaactgatgagtgctgtggatttctgtattgcgagagcaaggcagtatggaaaaccaattgcattaaatctaagctttggcaataattacggttcccattccgggaattcactgatagagacctatctggatgacatggcgaattactggaaaacgtctattgtgatcggcagtggcaatgaagggagcgcagcagtccatacagcgggaaaactgacgctgaatgaggagcaggaggttgagatcgcggtgagcgcgtatgaggcatccttaaatttgcagatctggaaaaattatgtggatgaaatcggtgtctctgtgatccatccgggcggaactgcgatcggaccattgcagcggatacagggaacccagagatttcagttaggagaaacaaaccttctggtgtattatggagaaccaagtccgtacaatccctaccaggaaatttatctggattttatcccagtgggcagttacattgacgatggaatctggaagatcaggctcactcccatccggattacagacggcgcgtttgacatgtggcttccggcaggaaatgtgttaaacagcggaacgggatttttaaatccggtggaggagacaactctcacgattccctctacagcgacgaaagtgatcactgtcggggcatacgatgcgagatttgaccaggcagctgcattttccgggagaggttatacgagggcaaccaatcaggtaaagcccgatcttgtggctccgggggtggagatcatgtcctgcgcaccgggcggcggctatcaggtgcgtaccggaacatccatggcgacaccgtttgtgaccggaagtgcagcacttttgatgcagtggggcattgtaaacggcaacgatgcctatctttacggggaaaaaatgaaagcttacctgatccgtggggcgcgcaaactgccgggttttacagtttacccgaatccggtgttaggctggggagcactgtgtacggcaaatagtattccacgataactctataaaatgttaaaaaacagaaaaatataaaaaaagttcacagaaatataacgttttgtgttatactttactatatgtagtggagattaaggtatcggggtacttatagttgaacagaaagtgatcagaagtaccggataatgacaggtatgggataattacgagagtatgagggacagaagatgactaattttggggaacattataatgaggaattagcgcagcaggagagcgagatcaataagagaaccctgtgggagatggtcggagcgtttattgttttgacggcggtctgggggctggcgtttggacgtttcccgacagtaaacgcaattgtgttcagtgtgacgtatgcaatttccacaggtttttttattgcgtctgtgatcttattttttaaagcagatccatcggatgagcgtatgaagtgtttttttgtgaccggcatctgcataatttcagcagcaatgaaccttatgttcagttaccacatggttctggtgtatgtatttccactcatcgtggcagttcagtataaagagaaaaacgtattatggctgtcttatgcactggaagtttttctgctgccggtcagcatgatcgtgggattttattacgggatctgtgatctgaacctgctgctgcagggaaatcataccagaacatggtatttgtctgaactggcagatggatttgcgaggatccctttttcgaagatgccggttgtggtcattatagtttaccggatattaccgcagcttctgatcctatttgtgttcgtgatgatcatccagcataccattggcagcatgcgggaggatgcttacaggattgcagaacttacctaccgcaaggaggtcgattctgcaacaaggctttataataagaataaatatgaagatatgcttgccaattactatacgatggtggagcgtgtcgccgtggttttgtgggatatcaataatctgaaagaaatcaacgaccgcatgggacatggcatgggagataaactgatcgagacaatgtccggtgcgatctatgcacagacagatagccggaaaaaggcatatcgtatcggtggggatgaatttgtcatgctcatcgaaaatccggagaaacaggaggcagagcagatcatccagaatgtcagggacaaacttgcaagacacagggaagaaggcggtctcagggtttcgagtgcaaccggtacagcggagggaaacggaatcgatatcttaaaaatagtacatgacgcggatgaacggatgtatgaggataagaagagaggaaaggagagccgcgaatatgctatgttttatagtgaatgagcattccagaagcggtaaaggcgcaaagatctggaaagaagcggaagcagttttaaaaaagaaaaacattgcttacgaatcatacgtcacccaatatgaggggcatgccttttcactggcacatgacatctgtgaatgtggggcggatgacattcaacttgtcgtggtaggtggtgatgggaccgcaaatgaagtcatcaacggaatgacgcattttgagaaggtacgctttggtgtgatcccgaccggttccggcaatgacctcgcaaggggacttggaataacgggaacgcctacagaggtgatcgggcatattttaaactgcagggaagattatgtgatggatctggggcaggtgagctggaacggctgtgagaagccgagattatttgcaatcagtgccggggcaggactggatgcattagtctgcaagaaggctttgaagtccaaggtaaaagacgctttgaataagctgcatctcggaaagcttacctatctgtttctgacggtacagtcgttatttaccatgcagacaacagatgcaggtgcagtttttgatggaaaaggacagaaaaaccataagaaaatgattttcgctgcggcaatgaatttccgggctgagggcggcggtgtgccgatggcaccgggggcagatgcgcaggacggaaagctttcggtgtgtatggcgtggggaatcccgaaatggcgtacttttttatgtctgccattgcttgtgacagccaatcatctgcggatcagagggtttgaggtgacaaactgtaaggaatatgatctgaagctgaaaacacctatggtacttcatgcagacggagagtactgtggggatgtcacagagatgcactttcaatgtctgccaaaaaaactgcatgtgatgtggtgatcgaataaatacgaataaaacaaaaattcccttcatacaatgtgataacatatggagggaattttttatggacaattatagcggaaataaagagtataacatttacagggatatcagaaaccgtaccaacggagagatttatctcggggttgtaggcccggtgcgcaccggaaaatccaccttcatcaaacgttttatggagttgatggtacttccttttatggatggggaagcggagaaagagagagccatggatgaacttccgcaggcggcagccggaaaaaccattatgacgacagaaccaaaatttattccgcagcaggcggcagagatccggctttctgctttcaagatggaagaagaaccgttaaagctgcgtgtaagactggtcgactgtgtcggttttctggcagatggggcagtaggacatatggaaggaaatgggagcagaatggtaaaaaccccatggtcagatcaggagatcccatttgcggaggcagcatcgatcggaacagagaaagtcatcagagaccatgcgacaatcggcattgtagtgacgaccgatggaacgatcggggaactggagcgggagaattacataaatgcagaagagagaaccgtccgggaactgaaaaatatcggaaagccatttgtgatcctgttaaactcggcaaaaccttatgcgcaggagacggtaaaactggcattggagatggaggaaaactatcagacaacggttgtgccggtcaattgtgagcagctgcgcagagaggatgtcttaaaaattttagagagtgtgctgtatgaatttccgattgaacgggtggaattttttatcccgaaatggacggaaatgctctctgctgatcatccggtaaaaagtgagatcattacacaggcatcggatattttaagccagatggagcgcacgaaggatgtttacagacagcagtcggaaccgggagaatgcatcacaaagattaaaatagaggagatggatcccgcgtgcggctgtgtgaagatccggatggaggttgcggagccatattattacgaaaatatgagtgaactggcaggagtgccgatccacggcgagtatgagctgatctcaatgatccgcgagatggcagcgagaaaagaatcttatgagaaagtcgcaggggcttttgaggaagtgcagatgaaaggatacggtgtcgtgaatccggtgttaaaggatatcgagcttgcggagccggaactgatccatcatggaaacaagtttggggtaaaaatcaaggcagtctccccatccattcatatgatccgtgccaatattgagacggagatcgcaccgatcgtgggaagtgaagatcaggcaaatgacctgatccgttacattaaagagggacagcagagcgaggagggcgtctggaaaaccaatattttcggcaaatccataggggagcttatggaggacggaatccggaataaaatcgccatgatggatgatgaatgccagcttaaactgcaggataccatgcagaaaatcgtgaatgataataacggtggaatggtttgcattatcctatgaaatttggtaagatttaagaatcaaaaacagtgtatcccgtcgggaaaatcatagatttttccggcgcgcactgcaatttatgacgatcggatgcccaaagtgcgggcattctgctgcaggatacaggcagtgataaaagtgggggatcggtatgaatattcgtttttatcatgcaaaaatattattgacgaaagcagatcacaccttcgaggtggcggagggggaactctgggtaagaggagaccatatctgttatatcggggatggcacagatacttcagctgtctgcaaagaagatgatatcattatctgggaccgggagatcgatgcaaagggaaatcttttaatgccgggatttaagaatgcacatacgcatacaccgatgacatttttacgttcttttgcagatgatcttccgctgcaggaatggctgcagcagaaagtgttcccgaacgaggcaagactgaaaggggaggatacttactggcttgcgatcctcggaattatggagtacctgacgagtggtatcacctcaaattttgatatgtacattatgcaggactatcatatcaatgcctatgtggatacaggtttccggactgtttttaccagtggattgaacaattttaccgacagtctggaagtgctggaggagaattatttaagaatcaacgggctgagtgatctcacttcctatgtgccgggatttcatgcagaatacacaacatcgcgtccactgcttgaaggggttgccaagattgcggacaagtatcatgcaccggtctggacgcacaattctgagacagagcgcgaggtggcagagtgtaaggcacgctggggaatgacaccaatgcagtttacggaaagtctggggctgtatgaacatggcggcggcggttatcactgtgtctggctggaggagaaagatattgagatattgaaaaaacaccacatgtcggtagtgacgaacccaggttcgaacacaaagcttgcttccggtatctgcccggtcaaaagactgctggatgaggggatcaatcttgcgatcggtacggatggaccggcaagcaacaactgtctggacatgttccgggagatgtttcttgtgacgggactggcaaaactcagggaacgggacgcttcctgcatgccggcggaggaggtgctttatatggcgaccgccggaggcgcatatgcgatgggactgccggattgtgactgtcttgcagtcgggaaaaaggcagaccttgtcatgatcgatctgagacagccgaatatgcagccggagaacaaccttgtgaaaaatctggtttacagcggtagcaagcagaatgtgaaactgacgatggtaaacggaaaagtactttacgaggatggaatatttctcattggatttgatccggcagaaatatatacaaaagcaaatgagataattggaaggatgaaggaatgcaggtaatatttatacatcacagctgcttcttagtggaagtggacgagaaagttttgatttttgactggtttgcgggagaccgggtaaacggttatacgttccgcggacaaatcccggagtatgagccggatactccaatctatgtgtttgcaagccacaagcacagagatcactttgacatggacgtgctccactggacagagcgttacagcaacatacattatattttctcaaaagactgcaggatgtcacctcattttctggaaaaacacgggtttgacctgtctgtccgggaattgatcacatacgttagtccgtgcgaaaaatatcaggtggatgacttggagattgagacgctgcgctccacggacgcgggagtcgccttttatgtgaagacaaacggggcaagtttttatcatgccggggatctcaacaactggaaatgggatggagcaggggaacttgtcaatggcattatggatgtcaattataagaaccagattaaaaaacttgcaaagaaagacatcaacctggcatttgtgccgtttgatccaaaacttgggatgtatcagtcacttggcatggaatattttctggagaacacgaatgcagagtatgtgtttccaatgcatatgtggcaggattattccgggatacagccttttatcaaaagactgagcaatcaggcgatggcggaccggatcgtgccgatcgtccatgagaatcaggtatttgagatccgggaagaataaaagatggtagtttttgctggaaaagatgacattttttttgaagaaaagatgacagcttttagaagaaaagatgttgaatacttgacgataaacaaataagtgagctataatatttaaattgtgagccggctttcatttttgcagtgcataagtgtcagccatagcagaaaggcaggtagaagaaatggcatttttaggatcatttttacagtatgcaattattatggtgattttggcagcgatcgctctggcgggatttttcgcgggtaaaaagctgcgggaaaacaaagatgcaaaagcagcggcggaagctgatacggcagcagaacaagaagttaaataatttgtaactatgtagatagtttcttggaaggaaacaactggtaattacaattttattaaataaaaaatgtacggcagagaaacacccgtacaaaagattttggaggaacttagtcgtgaagaaattttacggtgaaaacgaattacgaagaatgtaccttgaatttttcgagagcaagggacatcttaaaatgaacagcttttcattggtaccacacaatgataacagcttattactgatcaatgcaggtatggcaccattaaagccatattttacaggacaggaaattccacctcgcagaagagtgacaacctgccagaaatgtatccgtaccggtgatatcgagaacgttggtaagacagcaagacatcttacattctttgagatgcttggtaacttctctttcggagattattttaagcatgaagcgatcgcatggtcctgggagtttctgacaaaggttctcggattagaggaggacagactgtatccatccatttacggtgaggatgatgaagcattcaatatctggacaaaagaagtcggagttccggcagagagaatcacaagattttaccgcgatccggaaaccggagagtgtgataacttctgggagcacggtgccggcccttgcggtccatgttctgagatttactatgaccgcggagaaaaatacggctgtggcaaaccggactgtaaagtaggatgtgactgtgaccgtttcatggaagtatggaacaacgtatttacccagtttgagggagatggaaagggtggttacaccgaactttcccagaagaacattgatacaggtatgggacttgagcgtcttgcagttgtcatgcaggatgtagattccgtatttgatattgatacaatgaaagcaatccgtgacagagtatgtgagctgtccggcaagaaatatgaagtggatgcaatggatgatgtttcgatccgtctgatcacagaccatatccgttcctcaacattcatgatctccgatggtattatgccatctaacgagggacgtggctatgtactccgccgtatcatccgccgtgctgcacgtcatggaagaatgcttggaatcgacggcattttcatggcagagcttgcaaagactgtgatcaacgagagcaaagacggttatccggaattagaagaaaagaaagattttatcttaaaagtacttgcacaggaagaagagaagtttgcaaagacgatcgatcagggtcttgcaatcttagaagaaatggaaaaagagatgatcgcatccggttccaaagtattatccggagacaatgcgttcaagctttatgatacttatggattcccaatggatctgacttccgagatcttagaggaaaaaggcttcacgattgatgaagacggcttcaaaaaggcgatggaagtacagcgtacaacagcaagaaagaatcgtaagactacaaactatatgggagcagatgcgactgtttatgatgagatcgatccttccgtcacaacagagtttgtcggatatgataaattagagacagcatctacggtgacagtacttacttctgagactgagatcgtggaagcattatccgatggtgagatcggaacgatcatcgtagaggagacaccattctatgctaccatgggtggacagcagggagataaaggtgtgatctacactgctgatggtacattcaaagtggaagataccatcaagttattaggtggaaaagtgggacatgtcggcaaaatgacaagcggcatgatcaagtccggtgataaagttacgttatctgttgacgcagatcttcgtggcaagacttgtaagaatcattctgcaacacacttattacagaaagcactccgtgaagtattaggtactcacgtagagcaggctggttcttatcaggatgcagagagaacacgttttgacttcagccatttccaggctatgacagcagaggagatcgcaaaagttgagaagatcgtaaatgatgagatcgctgcagaccttgaggtgcgtacggatgtcatgaccgtagaagaagcgaaaaagacaggcgctatggcgttattcggtgagaaatatggtgagaaagtacgtgtcgtatccatgggagaattttccaaggagttctgtggtggtacacatgtaaaacacacaggcgagattgctgcattcaagatcatttctgagagcggtgttgctgccggtgtacgtcgtattgaggcgttgacaggtgataatgtattcgcatattataagaatatcgaagctgaattagagagagctgcaaaagctgcaaagacaactccggctgctctggttgagaagatcgagcatatgatggctgagatcaaggcgttaaatgcagagaatgagtccttaaagagcaaagctgccaaagaggcacttggcgatgttatggatcaggttgtagaagtaaaaggtgtaaaacttcttgcaacaagtgttgcaggggttgacatgaacggcttgagagaccttggtgaccagctcaaaggaaaactcggagagggcgttgtagtgcttgcttctgaggcagacggcaaagtaaatcttgtcgctatggcaacagaggaggcaatgaagaaaggcgctcatgcaggaaaccttatcaaagcgatcgcaggaaaagttggcggtggcggcggcggacgtccgaatatggcacaggctggcggtaagaatccggcaggaatcccggatgcggtagccgaggctaaggcagcgctggaaaatcagattaaataataatttgatgaaaaaaatagaattgtctgaatttttctaaatataagaaaaactattgacgtgaacattttttatgctataataacttatagtgcaatgaaatttacccaaacagttgaatatgcacaatacgcaactggagggaggttaggtgtgagataatgtctagtgtaatagtaaaagagaacgagactttagatagcgctttacgtagatttaagagaaactgtgctaaagcaggtatccagcaggagattcgtaaaagagaacattacgagaaaccaagcgtaagacgtaagaaaaaatctgaagcagcaagaaaaagaaaatacaattaatgtatgtaaaagaagctatcgtgtatgcggtagcttctttttttgaaatttaaagtcagtttgtcagaatcagtttttttgttggatctttttacctgaagtttacaattagaaaacaaaaaaaatacaattaatatcataaatatcttgacactgaaatatgtgtatgatagactttttttcgtgtgaaaaataaaaatcgttttttcatgcaaatgtatgaccactcagattactgaggcagcctaacggacaggcgggtcggttgccggtgtggtgaggagaccacgttattgattgagtcagaagctcaaattttataagttgattactttataatcagtgtgtaagcacatcatcttgtgaaacggtcaataagagtgacatatatttgcagttgcgatgcagacaaaggcagaaagcagagagcggcaggcaacggattctttgaaaaacgatatttgggatcgcatcaagagtaaaaaggattccaatatggagaacgaaggtcaacagagatgattgctcaggcagttgtctcttttttattacataggaaattacttcctatgtaataaaaacgctccgcgaggatgcgactgatgcgcagaagaattatgcaagctaaagcttgcacgcatcagcgcgcaaagagttgcgaagcaactctttgttctgtgatcgaaaacatgatttttattacataaaatgtgaaaataattatcttaaaaatgataaattgcaatggagaaagttatgaacagagaagatcagaaaagagctcccatttatgaagcgctggaaaaattcaggaaacagcgtgtcgtaccattcgatgtgccggggcataagcggggtcgtggcaatcctgaattagtggaattattaggggaaaaatgtgtagggatcgatgtgaattccatgaagccactcgataacctctgtcatccggtatctgttataagagatgcggaggaacttgcagcagatgcatttcatgcagaacatgcatttttgatggtgggaggaactacttctgcggtgcagagcatgattttgtcagtctgtaagagaggggataaaattattcttccgcgaaatgtacataaaagtgccatcaatgcactggtgctttgcggagcaattccggtttatgtgaatccggaagtgaatccaaaactcggaatttctcttggaatggaagtgccgtgtgtagagcaggcgatcaaagagaacccggatgcagttgcagtgcttgtgaacaatccgacttattacggtatctgttcggatatccgttctatcgtaaagcttgcacatgcgcatggcatgaaagtgctcgcagacgaggcacatggaacacacttgtattttggaaaaaaccttccggtttcaggcatggaagccggtgctgatctggcagcaatctccatgcataagtccggtggaagcctgacgcagagctccattctgcttgtaaacaaaggtgtcaatgcagattatgtcagacagatcatcaatctcacacagactacaagcgcatcgtatcttcttctgtcaagccttgatatttcaagaagaaaccttgcgttaagaggtgaggaatccttcgccaaagtgtccgagatggcagagtatgcaagaaatgagatcaacaatatcggtggatattatgcttatgggaaggatctgatcaacggaaccagcatctacgactatgatgtgacaaagctttctatttacacgcttggcatcgggctggcagggatcgaagtgtatgatcttcttcgcgatgaatatgatattcagatcgaatttggggatatctgtaatattttagcctatatttccattggagaccggacacaggatattgagcgtctggtgggggcgctggcagatatcgcaagactgtataaaaaagacagggcaggacttttatccggtgaatatatagcaccgaaagtcatccgttcaccacaggaagctttctatgcggaaaagaaatcccttccgatccgtgagacaaacggctgtatttccggtgaatttgtcatgtgctatccgccgggaatcccaatcctggcaccgggtgagatgatcacagatgaaatcatcgaatatatcatttatgcgaaagaaaaaggctgctccatgcagggaacggaagatccggcagtggaacatctgatggtgctggtgtaagagatgggtgatcccggagaaaacgatggaaaccgggacagggaaggagaagcagaaaaatggaaatgtggttttcggagcttcacacatcgaatgtaaagctctcaatgagaattgaaaaacaattattcagcggtaacagtgactgccagaggatcgatgttctggaatcggtagaatttggcaagtttctggctttggatggagatatccttttttccgaaaaggatgaatttatttatgacgagatggtaacgcatgtgccgatggcagtacatccggacgtgcgtcacgtgctgatcatcggtggcggtgatggcggcgttgcaaaagaactgacacagtatgattccatagaaaagattgatgttgtggagccggatgagatgttagtggaagtctgccgggagcatttcccggagcttgcctgtggtctggatgatccgcgtgtgaatgtgtattatcaggatggacttcgtttcctgagaaacaaaacagaggagtatgatctgatcatcaatgacgcaaccgatccatttgggcatactgagggactttttaccaaggaattttacggaagctgctataaggcgttaaaagaggacggaatcatggtttatcagcatggaagtccattttatgatgaggataaggaagagtgcatgaagatgcaccgcaaggcattccgtgcatttccggtaagccgcgtatatcaggcacatatcccgacgtgttcatccggctactggctgtttggatttgcttccaaaaaatatcacccactcaacaatctgcgcgtgaaagagtggaaaaaattacatatcaaaacaagatattacacaacgaatcttcaccggggagccttcatgctcccgaaatatttagaagatatgttagaggacgaggaagacaggtagaaaaatatattaagtaaataatgacatggataattgcaaaactcataaaaacctaaattgaacaattgaaagaagcgtaggaaggagtttcgcaattatctaaaaaacaataacgtaaaaaaaggagaaaaaaaatgagcagagtaatgattatcggatgtggaggcgtagcttccgtagcaatcgcaaaatgttgccagaacagtgatgttttcactgagattatgatcgcaagcaggacaaaatccaaatgcgatgcaatgaaagaaaaattacagccgacaaccaaaacagtcatcacaaccgcacaggtagatgctgacaacacagaggagctgatcgcactgatcaacgaatataagccggatgcagtgttaaatgtggcacttccatatcaggatctgacgatcatggatgcctgccttgcaacaggagtagattatattgacaccgcaaactacgaagcagagaatacggatgatccggagtggagaaaaatttacgaggagcgttgcaggaaagagggatttacagcatactttgattattcctggcagtgggcttataagaaaaagtttgaagatgcaggcattacagcaatccttggaagcggatttgatccgggtgtgacaagtgtttattctgcatatgcattaaaacattatttcgatgagatccactacattgatattttagactgcaacggcggtgaccatggctatccatttgcaacaaactttaatcctgagatcaatttaagagaagtatctgcaatgggttcttattgggaagatggccattgggtagaagtagagccaatgtctattaagcgtgaatatgattttccggaagttggagaaaaagatatgtatctgcttcatcatgaggagattgaatcacttgcaaaaaatattccgggaatcaagagaatccgtttcttcatgacattcggacagagttatttaacacatatgaaatgtctggaaaacgttggaatgctttccacaacaccgatcaactttgaaggaaaagagatcgtgccgatccagttcttaaaagcattattgccggatcctgcaagccttggaccaagaacggtaggaaaaacaaacatcggatgtattttcaaaggtgtaaaagacggaaaagaaaagacaatctatatttacaatgtatgcgatcatcaggagtgctacaaagaggttggttctcaggcaatctcctacacaacaggagttcctgcaatgatcggaacaatgatggttgtggaaggtctctggaaaaaaccgggagtctttaacgtagaggagtttgatccggatccatatatggaggcactgaataaatggggacttccttgggtagtctgcgagaatccgcaggaagttgagtaagaattttaagaaaacgaagatacaatgcagttgatataagtaggctgtgtttgcaaaattgttctgacagaatgtaaaatgtcggaaagcaatgacagaaaaaggaatgaacagacagaatgagaattgaagaattaaaaacaccgtgctatgtcatagatgaaaaacagctgaaaaaaaatctttccattctccagaaagtggaaaaggataccggatgtaaaatccttcttgcacagaaagccttttcctgcttttacgaatatccactgatcggtcagtatctcagcggaacaacggcaagcggactttttgaggctcgtctcggaaaagaggaaatgggaaaagaaaaccatgtatttgctccggcgtataaagaagaggatgtgaaggaactggtaaaaatctgcgatcacatggtttttaattctttttcccagttggaaaaatacaaaactctctgtaaagagaccagcgtgggaatccgtattaacccggagtgttccacgcagggggatcatgcgatctatgatccatgtgcaaagggttcgcgtctcggtgtgacaattgcacattttaaagagcagtttacagatgagatgtatgattatgtggatggactgcattttcacacgctctgtgagcagaatgcggatgatcttgcaaaaacccttgaggcggtagaagaaaaattcggcagttatctttacaaaatgaaatggctgaattttggcggcggacatcatattacaagagcagattatgacatcggactgttagaaaaatgtattctgcacatgaaggaaaaatatgatcttgacatttatttagaaccgggcgaagcgattgcattgaatgccggatatcttgccacaaccgttatggatgtggtagataacgatatacagacgttgattctcgacgcatccgcagcatgccatatgccggatgtgctggaaatgccgtaccgtccgccacttcgcagttcgggaatgccggaggaaaagaagtatacttaccggttatcttcctatacctgccttgcaggcgatattatcggggattattcttttgacgaagagaaaaaagtggatgacagactgtattttgaggatatggcgatttactccatggtgaaaaacaatacatttaacggaatcccgctgccggatatcgcagtgatggatgagagtggtgaatgtaaagtgatccgcagtttttcttatgaggattttaaaggaagactgtcatgagaaaatccggccggatggaagaacatgtgacaggatgaagctatgattcatgaaaagacaacacggaaaaggcaggaaaacagaagtatgaagatagaaaacagaactccgcatcaggatggattttatatgccgggggaatttgaaccgcaggatggtgtgatcttaatctggccgaaacgtccgggttcctggccatatgaggcaaaagaagccggaaaagtatttgcagagattgccaacaagctggcagagacagaaaaagtatatatgctgacagaaccggaaacggaagcagtggcaagagagttattgtgtgagaatgtagaaattttaacaattccgacagatgatgcatgggcgagggatgtcggaccaacctttgtgacggatggaaaagaagtccgtgggatcaactggagctttaatgcctggggtggaacctatgatggtctttatcaggactggcaaaaggatgataacgtggcagaagaattttgtaaacagaccggttatgattattatgatgcggctccttttgtgctggaaggcggttccatccattcagacggacagggaacggtgatcgcaacggaagcctgtctgctcagtaagggaagaaatccggaacttacgaaagagcagatcgaagcaaaattgcaggaatatctcggcgcagagaagatcatctggcttccaaacggaatctatcaggatgaaacaaatgaacatgtagacaatgtctgtgcatttacaaaaccgggtgaggttgtccttgcatggacagatgatgagagtgatccgcagtatgtactatcagcagaggatcttaaggttcttgaacaggagacagatgccaaaggaagaaagatccgtgtgcataaaatgctgatcccgaagaaaccggtctgcattacggaaaaagagctggcaggttacgtgtttgaagaaggcgaggatacaagagaagccggagaacggttagcggcaagctatgtgaatttttatattggaaataaagttgtccttgtgccgcagtttggagacgagcatgatgttctggcaacagatttattgcagaagctgttcccggagcgtgagatcgtgccaatctttgcaagggagatcatcatcggcggtggcaatatccactgcatcacacagcagataccggtacgcagatgacggatagcaggaaatcatataaagtatcgttgcaagacagatggaaagataaaaatgccggatttcagaataaacaggaatagaacgaaaaagcatggaaaatattaagaagcgggagacagcatattatgagcagaaaacgtaacgtcacagtagccgcagttcagatgaaatgcagcacaaatgtggaagaaaatatcgcaaaggcagatgcacttgtccgggaagcggcagaaaaaggagcacagatcatccttttgccggaactttttgaaagacagtatttttgtcaggaacgcagatatgaatactatgaatttgcaaaagaagtgaatgaaaatgatgcggtaaaacatttttctgcactggcaaaggaattgtctgttgtcatcccggtcagcttttatgaaaaagatgtgaaccgtctgttcaatactgttgcagtgatcgatgcagacggaagcaatctgggtatataccgcaagacacatatcccggacgatcattattatcaggaaaaattttactttgttccgggagataccggatttcaagtgtttgatacagcgtatggaaaaataggagttggcatctgctgggatcagtggttcccggagacagcaagagccatggcggtcaaaggagcagagctgctcttttacccgacagcgatcggcagtgaaccgatcttagagtgtgacagcatgccacactggagaagagcgatgcagggacatgcagcagcaaacctcatgccggtgatcgcagcaaaccgtatcggaacagaagaagtagttccatgtgaggaaaacggcggacagagatcagcactcacattttacggatcctcttttatcacagatcagaccggagaacttgtggcagaggcagaccgcaagacggaacaggtgatccttgcaacgttcgacttaaatgaaatgcaggagaaccgtctgtcctggggaatcttccgggacagaagaccggagtgctacggggatatctgtaaataaaaaaggacgcatgaagataccctctttactggacaaaacagtaaggagggtatttttaagcgtccctttgcttcttatggatacaagagtggttatactccataaaaaagtgccttttgcatcttttagtagccaagttcctctccaattaaaataactttaatccttccctgaataccgcttcgtcttgtgatcacgacctgattgcagatacagtcaggagagaggcagtcggcacagactccggtgacagcacatggtgtctgcttgttcagacgtacacagttcataggagttgcggttaagtggacacggtcaacagcttctgcaacgtcctttgcaaccttgttcattccggcaagaataatgacattttcaggaccatagatcaaagcagcgacccggtttccattaccatcgatattgactaattctccatcaattgtcatggcgttggtgctcatgaaatagtagtcagccatcagtgcgtcgtggaatatttttctggaatcttccggcgtcttacagacagcccggtctaaaaactcaatatcggctgaacgcagtgcatccatcatgccggtttcctctagtgtcatggagccgccgtgagccacgactgcaccggatggcaggaaagaaagtgctttctctacggcttcttttgcggtcgggcagtagtatgcttccattcttcttttttcaaaatttttgatcatggtattggcgagtgtttcgtaatattttgcttttggtgtcatttgatccttctcctcctatttaactttttgacttttattataagcggattttttcgttatgcaagcgctattaaaataattgaaaacgatcagattttcttctattaacaattctgaaacaaaactcaaacaaattcaaaataatatatgttatgatgtaatcaatggacaatgatagaaaccagaaaggaacagaaaaatgatacacattcttgtagtggatgatgataaaaatttaaaccagacggtctgcacctatttaaatgactgtggatttgaggcaaaaggcgttttgagtgcgaacgaagcctatgacgagatgtataacaatctctacgagctgatcatttccgacattatgatgccggagatcgacggatttgaatttgcggagacagtgcgtcaggtcaataaacagatcccgattcttttcatgtcggctaaggacgatcttccttccaaacggaaaggatttttagttggaatcgatgattatatggtaaaaccggtggagttggcagaacttgagatgcgtgtgagggcactgctccggagaagtaatatcgagatggagcgcaaacttattgtcggaaatctggagatggatgcggacggcatgactgcaacgataaatggggaggagataccggtcacaacacgcgaattcaatattttatataaactgttgtcttacccgaaaaaaacatttacaagggcacagcttatggatgagttctgggggcttgattcgggaacgagcctgcgggctgtggatgtctatgtgacaaagctccgtgacaagttttccacctgcgatggattcgagatcaaaactgtgcgtggacttggatacaaagcggtattgctatagaaagggactgcctgaaaccatgaacaaattgaaccataccaacacaatcaaaaatgaccgttttccatcttccctgtttctggtgtattttctcgtattgctgttaatgtccggtattcatacaggaattatcgtgggtatgaatgcactggggtggaacaaaatcatacaggtaattttaccgcttggttactggactgttgtggcagttggattgacactttttacgaaaaatgtgatccggaaaagctatgaaaagccaatgcatgacctggcagatgcaacaaaaaaagtggcagagggcgatttttcagtgtatgttccgacacttcacaccgctgaccggctggattatctggatgtcatgatcattgattttaataaaatggtggaggaactcggcagcattgagacgttgaaaacagactttttctccaatgtttcccatgagatcaagacgccgcttgcaattatccagaacaatgcggagctgctctgtatggaaaagaagccggagaaacaaaaagaatatgccgaagtgatctttcagactacaaagcgtctgtcggaacttatcagtaatattttaaaactgaacaagcttgaaaaacaggcgatcacgccggtagcagaagagtacgatctgtgtggacagcttgcggaatgtgccgtgaattatgagccggtgtgggagaaaaaagatattggatttgatgcagatatggaagattctgtaaagatcacggcagacgctgcgttgatggagttagtctggaataaccttctttccaatgcagtgaagttcacagaaccgggaggaacgataaagctgactgagcagtcggatgattctgagatccgtgtgtcggtggaggataacggctgcggaatgacggaagagacaaggaaacatatttttgataaattttatcagggggatacatcccatgcaatggctggaaatggacttggactggcgcttgccctgcgtgttttgcagttaaatgattataaaatcgaagtggaaagcgaaccgggacgcggcagtaagtttacggtgatcattccgaagaggtagaatattggataacagacagaaagcgaatttctgggaaagcgtagaaaaatgagtgagtttgagagttttgattatacgaaagtgacggttgccgagaatcagatgtcacagtatatggatggctacgagcattttggatggaaggtagattccaatgtccccatagaaaaaggaatgggaaaagtaacgatccacttaaagcggagcaggactgttttaaataaaatggaactgacacggttacagagacattttgaggcgtgcatgagtgagattgtggcgctcgaaaattccacagaatcttttgcaatgatcgcggcactgaccagtggggtttcaggctgtgcatttatggcgggttcggtattcgctgtgacggctgcaaaaccgatcatctggctgatgattttgctcgcaatcccgggattttttctgtggggaatcgcatatccgctttataaaaatgtgaaaaagtggagagcggagaaagtgaagcctctcattgaggcaaagcttgatgaggcggaaaaagtgtgcgagaaagggcatgcgctgttatagctgtaaaacatctgacggaaaaatacggtggcacgcttgtggcaagccaggagaaatacattttaataattccgaaacaaaacagaagcaattcgcaaacaaaacctctctatgatacagacaaacaaatgaaacacagatcattacaaaaaagagaggaaacataaaatgagcgaaacattatatttagtaacaggagcagcaggttttttaggaagtcatgtatgtcatcagttgttggagcgtggagaaaaagtaagagcatttgttcttgatggtgatccggcaatcaaatatattccaaaagaggcagagattgtaaagggagatctctgtgatatcgattcactcgaaaactttttcaaagcaccggagggaacagagacaatcgtgctccatgtggcaagcatggtcagtgtcaatcctgattttaaccagaaacttgtggatgtgaatgtgggtggaaccaaaaatatcatccagaaatgtttagagcacaaagagtgcaaaaaccttgtctacgtaagttctaccggagcaattccggaacttccaaagggacagaagatcaaagaggtaaatgagtttgatgcagagaaagtcgtgggctggtacagcaagaccaaggcgatggcaacacaggctgttttggatgcagtgaaaaaggaaggattaaacgcatgcgtcgtacacccgagtggtattttagggccacaggactatgcagtgggggagactacaggaaccattattaaaatcatcaatggcgaaatgccgatcggcatgggcggaagttttaacctctgtgacgtgcgtgaccttgcagcgggctgtatcgcagcagccgatagaggacgaaaaggcgaatgttacattcttggaaatgaggaagtaacgttaaagaaaatgtgtgaactgttagacaaagatcttcactgtggcacctgtaaattttatctgccgctcggattggcaaaactgctcgcaaagcagatggagaaaaaggcagcgaaaaccggtgcgaaagcattgatgacgacattttctgtctacaatctggaacgcaataatgcatttgactattccaaggcagaaaaggaactgggctatcatacaagaagctatgcggagacattgcatgatgaggcagtgtggcttagagcagaaggaaaaattgcataaaaggcagtggaaaggaaaaaagtttataatggagatttttgtgatatgaaaaaagtatgtgttgtaaccggaggcggctccggaatcggttttgcagctgcaaaagaggcagcaaaaaaagggtactatgtaatgatagttggacgaaatgaaaaaaaacttgcaggtgcagtagaagaattgagaaaagacggatgcgaagcagaagcgtatagctgtgacgtttcagacagggaacactgctttgcattggcaaggcatgcggcagaatgtggggcagtaaaggccgtgttgcatattgccggaatgagtccgcatatgggagatgcggagaaaatcatgcaggcaaacgcacttggaaccgtcaatatcaacgatgcattttttgaagtgatcgcagagggcggctgtgtgatcgacacaagttccacttctgcttacatggcaccgtcgtttattatgccaaaaagggtttatccgcttgcatgtacagaccggaagctttttatggataaaatgatgaaaaaagtaaaaatgtttccacggaaaacaagagagggtgtcgcctacagtatgagtaagcattttactatctggtttgcaaagcaggatgcagcacgttttgccagaaagaatgcccgggtgttaagtattacgccaggaaactttgagacaccgctcggaaatctcgaaaaagaggaagcgtccacctatctgaaatttgcggcaatcaagagaaatggactcccggaggagattgcaccgctttatgttgcactgatcgatgagaggttaagttatctgaccggcacagacatactctgcgatggaggctgtatcgcaggcggagccagtgcctttgcgagataaaagttatagtaattagccgatcaaattgaatcaattgtatttttataaagaatccgctatactgaaacagatttagtatagtggattttttgcatttgggagaacattttgattacagtagcaatcgcagaggatgaagcggcagtcacaaggaagctgacgaatatggcgcaggatggaaaaacatgggagaagatgaatgcataaaatgaatgctaaaaaatccgcagattattgcaagctgatagaaaatgtaaaaaacaaatatcgaaaaaatcctatatatgctaagaacacaccacatattaaatatatgctgataggtcaggatttcggaccgcctgaaaaggaagagataaagggtacgattgcaaatgtccgtaagatgaatgatggtatagatgtgatgttccatgaaaatgtagatttggaagcaagggattcacagacggataaaaatattgtcggatactttgaactgcttggtaaagaaaaaattgatgagcataaatatccagatttgtttttctgcaattgtaatttgggctatcgcagagataagtattctggaaatatgaccagaaagatattggcaaatgatgcagccgaaataaaatcattgattgacattatagagccggaaaacataatctgtctggggcttgatacatccgtggttgtaatacgaactctgattgataaaaagttttcctgtaatagagtatctgaacttataggaactggtgaaccttatatttatggagaaacatatatataccctgtagcacatccggggtattggggtacaagaacaagaggggaagataatgttattgcagattggatgagaattagaaaatagggaggtgccacaatgccatttaagattgtccgcaacgatataacaaaggtaaaagcagatgtgatcgtaaatactgccaatccaaatccgatatgtgcaagtggcacggatttagcaatatatgaggcagcaggaaaagaaaaacttctcgccgaaagagcaggtatcggtaagattgcaagaggtgatattgattcttacatagatgctaattatgtcagggaaagtcatagaaaagaatatccggtgcgaagcagaagcaacgcccgcatgagaggattgacagaggaacgagaataaagatccatacaatatattagttgagaacaatcgagtatataaacttggaggatgggaatttcttgatatagccaataagctttttgacaatggaaagtaggtggactggggaagctatgcatatcagtgcacaaaggagcaactggaaaaactgatggaacagactggatgtgaaatagataagatgaatgaactgacatctgagaaaatctatggtattgtgtttgttgaagaggtgtaaatcttttagagaccggagaaattctggtctctttatttcgattaccgctgtcaaataaagacaaaatggtttatactttttatcaagtgaaagaagaaagcattaaaagtagatttgatggcaaaattataaaaggaatgatggatatacagttagttacagaacttaaagattcactgcataattacgatggaggtttggcgattgaaagaagagattctagaagaattaaatattaaagaaaatcatgaacgagaatgtaagctggcagcaggtggacttcctgagagcatatgggagacttactcttcttttgctaatacaaatggtggcacgattctgcttggtattagggaatacagagattcttttacagttgaaggactgacagataagcagattgttaaatatcagaaggatttctggagtactttaaatgacagaaataaggtgtcaaagaatatcttgctgaatcatcatgtcagacctgtgatagtcagggaaaagaaaatactcagaattgatgttcctgcggcagacagacacgataagccggtttatattgggacagatccaatgaaaggcacttataaaagagattatgaaggtgacttcctttgtgccgaagaggcagtccgtgcaatgtttgcagatcagagagatgtgtcaggcgatgtggaggtgctggaagagtttggattagatgtgctgaatcaggatacgataaaaggctatagaattatttttgaacagcttcacagcggacatccttggaatgctttggaaaatgatgagttccttatgaaattaagggcagcagcaaagaataagaatggtacattatctccaacgatagcaggactattattctttggagaggcgtatcacattacggaagttttcccgaattattttctggattatcgtgaggaatgcgatgataaagcagtacgctggttattccggacacattctaacgaaggggattggagcggcaatatatacgactttttctgtaaggtgcgtacaagaatggacgatgatatagcagttccatttgcaaatagacgaaatggatatcgtgtagacagagtggatgtgcatgatgcattggaagaagcattggcaaatgcactggcacatgcaaattattatggcagacgaggaattcttgttgtaaagaaggggaaagaacttagtatttccaatcctggtactatcagggtgacaaaagaagaattttatgcaggtggcaatagtgatccacgaaatccgaatatcttaaaaatgtttggttttgtaaatgttggtgagcgcgccggaagtggtgtcgataagattatgactgcatgggcagaacaaaactggaaaaaaccggaatttgatttctcagagcgcagtgacagggtaacattaaagctcgaagttggacaagtggtatatattccgggggctgctgatatcagaaatgaaaatacaaatcaggaaaaagcaactgctgtgtcaaaagaagataaaataattgagtatatcaggcagaatggaagtatttcttctcaaaaagccgctgatatagggggttataagtcaaagacaggagctagaaaattgcttgataagatgatagaaaaaggattgattacgaagattggaaatggaccggcaactaaatatgtgatttagtggtcacattgatacttatcgaacactttattgaacactatcggacacttttgcgggctgtcggatacaaagtgttcgataagtgaccatttatcggacacttattagcataggctgaataaaaatatttgtgcagagactaaccgcacaaatggattagaaggtgaaatatggatttacagaacatacagaatcaattaaatacagaatttgccaagtcagagacaagaatcatattctggtttgatgataaagatattgattacataaatgaaaaagtgttggacacaatcagcaacatgctgcagggagtgcatccgaaagtggcataaaatgtatccagaaaaggaactaagtcaggtgcagctggattatcttgtagatgtaattatgacatggattcaaaaagaaatggagagaggttagtgcagatatttgtagatgcagatgcgtgtccggtagtgggcattgtagaagaaattgcagagaaatataatattccaaccaccttgctgtgtgatacgaatcatattttgtattctgattacagcgaggtgattgtggtaggtgcaggagcagatgcagtagattataagctgatcagcatttgtcataaaggggatgtagtagtaacgcaggattatggtgttgctgcgatggctcttggaaaaggtgcatatgctattcaccaatccggtaagtggtacacgaatgagaacatagatcagatgcttatggagcgacatcttaacaagaaggcaaggcgcagctctcataaaaatcatattaggggaccgagaaagcgtacagaagaagatgatgtacgttttgcacagtcctttgaaaaacttatactgatggcaaagtcaaaagaaggtgctcagagtgggactatttaagaaaaagacagttacaaagacatatgataaagaaaataagaaaccagttatcaaggcgagcatatgtaatggcgagcaggttgcaggctttaaggacattcatacgggtaagatagaagaggttatgctgattaagaaccaggcagaccttgatgcattcaagaaaatgtatggaataaatggagagatagagaaggaatactgatatgaatatacagatatttggaacaaagaaatgcaatgatactaagaaggcggagcgttttttcaaggagcggggcataaagtatcagttcattgatatgaaagaaaaaggtatgagcaaaggagaatttaattcagtagctcaggcaaatggtggattagaaaatatggttaactgggatggcaaggacaaggatttgcttgctcttattaagtatatcgcagatgaagataagctcgaaaaggtgcttgagaatccactggtaattaaaacaccagtagtaagaagcggaaagcaatcaacacttggttatcagccagatatctggaaaggatggaacttgcgagaatgatacgaatcgtatcacgtatgtgaaagagcgtttctacccagtatacctatcggataaaacagctcgacagtgactatttttcagaagattattattaaggaggcgtatgcgatgaagctgttgattaaacaacgtgttttttcgtggtcagacacttacgatgtctatgatgagaatggcaatccaaaatattttgtcaaaaatgagatctttgccttgcttcacagaatccatgtcagtgatatgcagggcaacgagattggaataataaaacagaattttacattgttcataccgcactttgaggtggaaataggcggatgaaatcatggcgttgatgcgtgtcattgcaattgatgcagcaaactgttcacagaataattaacaaattgattggtatgagacatatcattttgttatatcagataatggaagcggaatgttggaagaaaaaggaatcaactgaatcaggggatagattttaccggcagttatctggagaacggagagaatgtacgtaaaaatcactcttttgaaaaattgagcatgaaatgatgtttttaaggattactgtggcacagaccatttcatttcttatagtactttttattttttggaaaggaaaaatcatgggaagaaagggattattaataaaacaatttctgaataatgcatttgtcacaactgctattgtgctgatagtgctgtctgttgttgcattatggtatgatggaacaatgatctgcatatcaaccatctttgagactcttttactaagtgttgtttgtgaagtgatcaaacacatgatgtataagattgatattgcaaatatttatcttggtatactgcttcattatcttctggtattagcagctgttctgatatttgggtatgcatttaactggggtaatcagcttcctgtctatgttttggctggaatgtgtggtggtgttttaatcctgtgctgctatttggatattagtagagttaaggctgatattgatgaaattaatggattgtgtgaaaatagagtgtaatcatgctcgtctgttttgaccgtataactatggtacgttatagtcattgacgtgatgatcaaatgaggtcttccgttaattggtcaatggaggcagcttatgaatgaaaaattttatgcattgctggaatatctggaaatgataaaacattgggaaatagtttatggaaaggaaacggaaaatgacagaaaacagttataagacaccctgtggctgcatccattattttgtaaatataatagacaagcagaaaattacgttagtgtttttgccgggacttacagcagatcacagactttttgagaagcagatagaatattttgagaaaaaacagaatgtgcttgtatgggatgcaccatcacatgcattatccagaccatttacgaataattacagtctgtctgatatggcagaatggctttatgaaattttagcaaaagaagaaatatataatccgatcattatcggtcagtctatgggtggatatctggctcaaatgtatatggaattatatccggataagataaaaggctttatctccattgattctgcaccgcttcaaaagtcttatatgactgcaatggaaatatggcttcttgaaagagcagagccattatataagatatatccatggaaagcgcttcttagggctggttcaggagggtgcgcagagacggaatatggtcagaatcttatgcgtaagatgatgatgtcctatgatccagatcctaaagaatatgcacggcttgccggcttcgggtacagaatgcttgctgaggcaatcaaagcggatctgccatatcgtatcagttgtccggcacttcttatctgtggcgaaaaggataaagcgggctcagccaaaagctacaataaaaaatggcatcagagagaaggtttaccgattaaatggataaagaatgctggtcataattccaatacggatcagccggatgaagtcaacagactgatagaaaaatttatcggcgaggtagatggaaaaaatttagcaaaaagtaaaaagacaatactctacgaagcgtagaatccgcacatattcaccattttctacgttccgtgggtgtaaaacatctattttatatactactctgtggtcagaaaggaggaaaagttagaataatatatatggtttgtgtgtgacaatcatcaaagaagacgaagagccgatgcacttgtaaactgtttcacaagatcatcggctcttaattaacatattggcgggatgtatccgagttgaatcgcttttgtcacggcttcaaccgctgatgtaacatcaagtttttcaaatatatgctgcaaatgatttgataaggtacgttcactaatataaagtgtgcttgctatgtcttttcgcttttgtccctctgctataagctgtataatttgtttttcactatcggtcaatccttctatgaatggaatttccctgtcaaaataaagtatccactgcattattttagaaagaatagatatgagcttttcaggttcaatatttttattaacaaatccttttgctcctatttttcttccttcacttcgatatacgggcaaatcataaccagacagaattacaaccctttgttctggataacaacttagtatttgttttgctaattccagaccatcctcagaagatatattcttcaagtttatatccataaggatgatgtctggtttcttagatacaatataattgtctaattgagaaacatcattgatactatcaaaggtttcaatttctgaataatctgacaatgcaatctccaaacttttagaaaataaagcatggtcatctactaacaaaatgttgataagaaacatctcctttcatcggcaatatcgtttgtacgcaaatcccatgtggatggttattagatatagttacagagccatccatgtcattcactcgttccgtaatcattgcaagtcctcgatgttttaacctgtcagcagatgagagaacatctgcatcaacagttccattgtcactcacactcagtattataatcccattatcctgcgtaagggttatccatgctttttcccctgtcgaatgtttgtaaacattcgtgacaagttccttcagcaggcggtacacaaagatattgtatggctcaaccagaaataaggagtctgaacaatcaaaggagacacagagattacgattcggaaaagattgcgaaataccatcaagcaagttttggtagttttcctttatagtcagttttggaagcaatgtaggatggtaatcctgcatttgctcacgaatataagtattcatattatcgagagtttccgtgataattttctgtacttcagggcggtctgcttttttcatcatattttttacagaaagcaggtcttgaagaatatcatcgtggagaaagtttgcaaattcaagatttaattgttcttcccgttgtaattgttgtagtgcgacatggtatttgctttccttgattatcttattttgccctttcttaaaattgaaatccaaagtaatattacaaacatataaaaacgcaaacagggcatcaagcataataaaaagcaaagaatatccaccatctaaaattattgctatcaaactaaaaataattactcctgaaaaaataagtaatgttaattggcgattattgaatacgacagataatggaaggctgttatgttctttcagtatgataccgtggacgcttacccaaaacaatagtataggaatatatacaccaaaatttgaaagatgttcgggaactctcattgttgaaaaataatatgtaaggaataaaactataactgtaataagggagaaaatgatatgcttccattctgacttaaaaacaaaagcaactctttttctatgatatatcacagtaaaaataaaacacagccagcttgccataaattgtatgaaatagagcaggaaaaatattttacttgacaccaatacgccgataatagtacaaatacaagttcccatcaggcagaaattaattgatttctgatatttgtatccgctgttttggaacaaaaacattagtatgaattttatggaaacacaccatattaccgggcttaaagcgaaaaaaatagtgtttgtgatggagttgcccgaagctgctaagagtatataccaactttccaatgctaataaaccacaaaatagggaaatagttttattttccctaatattacaggaacttacataagtaacatctattagcagcaaagacgataaaaataagggaatgacacctctggtgtttaaatgaaaatctgcatgagcggtcagccccatatatgcaatgagtaaaatagaatttataaaaagcagtagctttaaaattgtttgcttcatgttttgcctccttcctattttctcattaaattatactatctctctgtgaacaaataaagtgtacgaaatcgccgagctataaaactcgatgatttcatatagctttttatttctttagaactgttttacagcaagtatggacagtcacacagtaatatatcatataaattataaatgtaagcagaatagcgataaacgtaggaatatacagaataaggctttctttcagaatgttctgcataagggctgtcctgtatactaatgttgcaaagacacagtctaccaacccgaataaaaacggaatactaaaaaaagatatcgtctgcttctttattatttttttcaccgttctgtctgtgtatcccatttttcttaagatttcataatcatccttcgaatcgcttatggcagaaagattattaaaatataatatgcttccagttgcgataaaaaacaagattacaagaaatccaagcagtaagaaggttgaactgcttagggaaaatatctcatgtatcctatgcgagtttccctgtaaataaggactatcatttaaatattcggataaatcaagaaacagagcttcattatctttgattgactgcccatttatacttaggacttccgtttcggggctaatttcttctgctattgcatcatataagtcgtcacttacaatcaaagtaccaatgctatttgcaaatgaaatgggattatctaaagtagttgcgatgactgttacagatatttcttcattacctataagcaaaggataaacattacccgtttcgtcattgtctgaatctggctggtattttactaaaatgcactcactatcgtgtagctcgccaatttgttccaaagccccttttttcccttgtgcttctaagagagccatatagtttgaataagagatacattcaaaccctgcatttcgcagaattttttcgttatctgaatcacctttagagcttcctgcactatattccaaaggaacttgttcggaagtagatgtaactttataaatattcgtttgcaggaatgaaacatcatttttggacgaatgctcatttacaatttgtttgattgcatctatttcgctttcattttcaattctacattcaatttctgacggtgccatacgtgacacagcagctattggatagtataaagataaagccataacgctggagacggtaagcgttgctgcggataacagtgtaagcatgattaaagtcttagagtttgaacgcatacggtatatgaaatttggggaagtaattatttttgtttctgtataaaacttccgtttgttgtttttgcttatgtgtactacaaaaggaagaaaggatgaaataaaaagtattgttcccacaactacgagtacaagtgtcagcatggcaatgggggtataaccaatcgaaaaccaaacagatttatctcctctgaggatatccaatgcaagaacataccccaaaataatgcagcaaaagccaacgatggcaggaacagcatgaaatttcatttttcgttcagcacttttttcaaatctaactaatcccataagcgatgtcttgaaaagaaacctgctgttagacagcatcaatacaatcacgatagcaaaaataaagcaagctgtttttgaaatggcattgacattgaaaaagggtatttttgaattattgatagataaatccagtaacttggttatgccaaaaacaatgcctttatgaaaaaaactaccgagaagtattcctactataaacgctccaaaacaaaccagtaaattctctgttgtcagcaatgacaacactgtggtttttctatatcctaataatgcgtaaacaccaagttcttttgttcgacgacgtaaaaagaaacggttggaatatgacatataaaaaacaacaaaagccattaggaatacagaaattacgttacacatcatttcaacccgcccgttaccagatatcttttcaagcataattgtattcattgagaatgaagtaaatgcaaaaaagacagtaattacaaatgatacagaaagcaggtaaagggcgtaaaatgaaaaatttttttttagatttttaagtgccattgataaattattcataaattttgcccccttatctttccgtatctaatttggctacttcctgtgcaatggtttcatagaatgttcgtctatcggcatcctgtttaagaagttcgcgtataatgcttccgtctttgaaaatcagaatacggttagcaaaacttgcagcgtatgcatcatgtgtgaccattagtatagtggtatgcaattcttcatttgcttctttcaaagtttttaataactcggtagcagagtttgagtccaatgctcctgtcggttcatcagcaaataaaatacttggctgttttacaatggctcttgccgccgatgctcgttgtctctgcccgccagacagctcgtttggatatttgtctaactgagaggcaatgccaaagcgttctgctaaacttcgcaccattttttcgatttttttatgcggaagcttttgtaaagtgagtgggacagagatgttttctcggatggtaaggctgtcaagtaaaaagtattcctgaaatataaatccaagattatccctgcggaaatccgcggaacctgtgtcgctcagttgttttaaattaacaccattgattacaatgctgccacttgtaggggtatcaatagtggaaagaacattaagcaatgtagtctttccagagccagaagcacccataatagcgataaattcactttctgctacattgaaagatactttatttaggcttggacgttgccctttagcatagatttttgttacttcatttgcttctaataatgttgccatattttaatctccttttcgtttgatagtttcattgtactttttctgcttaaaaagcgaatgagtaaatcaggcaatttttttaatcgtattgtctgttggtgtgataaaggagataaaatctatgatttatgatgaatgggtgtttcacgatgtggaacatatttgtttgcaacttataaaaaaataaggtgtgcgatttatagtggacaactttcagcaggcgaaaaaatcccatctgttcgagaaatggcaaagaagcgagaggatactgcaaaggtactttgtttttcttacttcgataatatgtttgcattaggattttccaaagatgaagcagaaaatatccgatcagaagatgccggagaaaccaaagaccaagtggcaggaagcaagtttataaagttttatggaaagagcaggtagcaatctatctgctttttcctgttatgtggttatcgtaagccgagaaggttaagtgacgaacaaagggaacaggcaaggttacggatggagaaaatcaattcagatgataattgtcgggaagattagagtccagtcgcaacattcagaagtccagtcacaacatttctgaattaaaagaaagaaatctgccgataatataaatgaacaatagatgatgttatccatatttgataatgagccatgaaaatgaggtggaacagttgaacatagcaatttgcgatgatgaggaaaatatacgcatttacatacgcaagctgatacagaagcaggaacctttttgtaagataacagagttttcatcgggcaaggaattattggagtttcaggatgagacaaatgcagaagaaatagacatactttttctggatatctctatgggagatgaggatggaatgactgtggcaaagcagctcaggagccagatggaaagcaattttgagcaggtttttgcacagaccatacgggagtatcaatatttgatggcaaagaaaaaggaaaaaccaaaagaagtattagttcggaatggaaatagaacaagaagtgtttcagcagatgatatttactatattgaaagcagtaatcgaaaagtgaccttgtatttgcggcatgaaaaaattgaatattatgacaagatcagctcactggaaagcgagcttaagccggattttttccgtatacacaaagggtatctggttaacataaaatatgtggaacgatatgaccggacagaggtgaaaatgagaaacggggacagtctgctgatatccaagtataaatatcaggactttgtaaagcgttatttggaatacatttcggaggaaagataattgagtcaggttacatatgaaatcattcgcaagctttttgaaatctatcctattattctgcaaatcgttctttttctggtattgtggaatgtattttttcggtgggagaaagggatatggattgttgcaggaatattggcagtgatgaatatctgcatggggctatggctggaaaagccgggggtaatacgatatacaatgtccgctgtcattgtgttgggatattgtttttgcaaataccaaaaacatttggaaaaggcggtattcatactgctgctgttttacaattttcatgcgttaagttatttgattgcagacagtatttatcaatgtacagtggagagcatatttagagggttggatgttctgagtgaggaatatatatttcgggtttatctgggtatggcgataggtatgggcatcctgcttttatcgtacacgttggtattactgattatgacaggtgtcgtgataaaaatcgtaaagaaaccgtttatgctgagatggcaggaaacgatattcctttcagtactgaatattgtagggagtatgattgtaggaataagcgtagacctttccgtagtgcaaatcgagggtggagtttttctgttgtatgatgacaagcaggaaatgttgtggaaattaccgataattgtggttcttatctatgtgggggaaatttcggcaatatacatctaccagaattacaggaagcttcaaaaagaacggcagaaacattttgtggaagaacaacaggtcaaagccatgaagcagagactggaagaagcagagaacttctacgggagcattcgcagagtaaggcatgagatgaaaaaccatatgacaaatataaaagggctggtggcaagtgagaaatatgatgaagtagagaattatatcgaaaaactggatgaaaccatacagactatggactataaattcaatacaggaaatgcggtcacagatgtgattatcaatgataaataccagaaagcggaaaatgcaggtatttcgtttcaagtaaaatttaacttgggggaaacagacacaatttctgcatttgatataggtatcattctgaataaccttttagacaatgccatagaagcctgcgagaaactggagcaggaacagcgatatatcaatctgacattaaagaaaaagaatcatttcctactgattgaagtggaaaacagctttgatgggaaagtgatatggaaagatggaggtatcgtcccgatgacaacgaaacagagcgatctgccggatattttgatggagcatggaatagggttaaaaaatgtaaaggatgtggcagaccattatcttggagatatggatatcaaaataaaaaacgatgtgtttaaagtcacagtaatgctgcagcagaaggaaataaattaaaaaaaaatatgaaaaaggaaggagaatgtagtaatggaagtaggttcagtttatggcagttattatgaaacagcaaagagttacatgggtttgaggaaggaggaaaaacaagcgggatttgcggaaaaggtcacagacaaaagtcaggtttcctcggaagatatgaccttggaggaatacaaggagtattttaatgaaaagatgaattcattatatacacatccatcgcagcggaatagaaatgatattatagatattacggatgccgcttataaaagaatgcagactgatccggaatatgagaagaaaatattagacgctttagcgaagaataaggcagttaattttggaaactatattccacaaatatcatatatgcatatagatgacacatatgagaaatgttacggctatacgcagggcatgaaggagaatgacggttattccgggagttcctccgcaaagggaactgatgccggacggcagaaaaaggcaaggcagaaggaactgctggaagaatatttggaaaagcgggcgcagatgaaggaatttcagcaggaggcgttggaagaaaagattgcaaagcaggaattggagaggagcaggctgacaaaggtgtggagcagtaagaggcagatggcagcggcaaccaatgcatatgaatcaaatgtaatgacagagacatcgacgggtagcaattcactgcttggctaaatgcgggcattaagcgtggactaaccataagggggcatatcgtgcaatattgcacatagcaattccaactgacagaggaattgcagaaacagataacagccggaaatggatttcacaatatatcaaattcaagggaggattcaaagatgagcattagtggaataggtgagaaattttaccagaacaatgtgacaacaatgaaaagcaccaaaaatgtaaacagcacagaagaattcgcattagaaaaaaacaagcggaacgcaggaattgtcggaagcggaagaaatggaattattcaaaaaggaattctatgaagacctttctaaaattacaaaccacaggacagtgagcaatgcggcggtgaatatatcggaggaggcatttaaggcaatgaaggatgacccacaatacagggagaaagttctttcactgatccagagggattggggcgattcctatgcaccgaggaactgttctgtgctgataacagtcggtgcgactttgaatgagtatagggcggattcatggcctgtgggttatgactctgaatttgatatgcgttcacagaacagtttctataaaaggacgagtgaaaagaaagacaggcaaaaggaactgctggaagaatatctggaaaagcgggcgcaggctaagaaacagcagctggaaatgttaaataaaaaaattgcaaagatggaaatggaaagaagtagacagactcagtcatggaacagtgagaggcagatggcaaaggcttccaatgcttatgatgcaaatattatgatggaagcagagcttgtgaagaacataaccaaaggagaaaacaatggaaatttcaaataatcaatcttattatatcaatccgaataccagacaattcacatcaaatgtgaaaaatacagcaataaaggacagggaggtcttcaatggttcgatgcagaatctgttaaatcccatagaggatttggtataggtgctcaaaacgccgattaagctggtagatagttcttctctaaacaggctgagcaattccgtcaatattgcatccgacatgcgcatcgctgtaaacgacggttacatattgaaggtaaagcaacagggtgtggaggtttccggcggtaatgatccttatgatacagaggcatatatgaaagcgcagaagatggcgggttcgctgtctacgctgttgcggaatgcttgtgggaatatgcacacagtagcatattctcaggaggagtatgccagatggacagaaggtgtatccgatgtgatggggtatctcggcatagattatagcttttacagatgaacgaataaatgacctaatgttggagtggtcaacggatgaagatttttgggtgcgccgaattgctattgaccaccagctttgtaggaaagagcaaacaaatacggaattgcttgaaaaaatattagtgaataactttggcagttcagagttctttatcaacaaagccatcggttggagtctgagagattattctaagacaaatcaggattgggtaagaaattttgttgaaactcataaagacaagatggataaattgagtatcagagaagcaagcaaatatttataagtcaaatgggaaacacaaaattgggttttatgaatgtccctaatggtgatgtaatagcatttgatatgaaagagagtgaaataaatccgtctgtggtatatcttagccatgacgatggtgaaggacatggatatatactgggtaaagattttaatacttatttagaacaattgttattggtaggagcatgtggcaatgaggattggcagatgttaccgttttgcttggatgcgcaatcaggaattgtatcagattgtgaaaatgcaaaggagtatcgaaaacttatagggttacagatatagtaagaggcacgcccaaatttcaggtttcgttccattctgtaaagaaaaatgaatgaatgtcgataaatattatgagctaaggatggcgtctgttttcaagggattgaatgtgaaaatagacgctgtttctgtttggattggaggttatattatgagaatacaagcggcaaatacattttatacaggtacttactctgttttgaatacgaagtcatcatttccatatgctgtgaaagttgaaggttacggaaatacaagaaaccaaaggagtttatttcagtttgcacatgtgacaataacagaacatatgataaatgcaaaatatggtacaaagattacaaacggtccgagagtgcagatgcagaccgcaggtagtaagaaaaaagaagattggactgaggtttccaaagaacagttggcagaagtaaaactaccggcatcatttgataaattgaaagaacaaaattcttatttttatcatggagaaaacatatcggattatgaactagtgcaaactgcagtagcattggggaaaatggaattaccaacagatgagaaaaagtgtatcccagacagagttgcaatggatgcatttgaagtgcttgtcagagaccaggcggctccaaaaaactcatggtcaaatacattgtattcggaagatggaaaatatacctttacaaagactgaaagcggaagatggcagatgcatttgattgatgatgctgccataggtgcatctttggaagatatagcaaattggatgatgagcggcacgcccaatagaaatattgagacacgctacctaaattatcttcatactgttgatccggatttatataatgtggcgatgcgaataggttccgaggttcgttcttatggttttatggaggatttacatcagcagggagtattaagtgatagtcaaaatcagtatgatatgagtctgttgggtatgttattcggtaaagatgcggatagtatgcgtatgatattgaatgggtgtaaggagtctggtaattttttggaattattggatttgtatagcccggatggagcaaaatcgttggataagcttcgggaacagcaatataagcacggtggaattgtttaatatagcgagttttatgacaggatatgaaaaagcaattaattctcgaagtagaagagtgtgaaacactaatgtagcaacggaggtaaagacaaacagcaaggacaaagtgcaggaatattatgagaaactgtgtaaaaagttcccggagattacttttaatacgggtagcagtcttatgagtggaaatgaaaataaagtggtaataaatctttctagcgaatgtctaaagaaaatggcaaatgatccggaatttgccaagaaagtagagtttaatttaactggtgcagtaccgggacagaatagaatgtttgcacaagccaaagctgataatgcagtgatacatggtgttacaactgtaatagatgccgatgggaatgcttctgttacttgcggaggtatgacaagaaccagtggttcaaaacaaaattcaactacattgaatgcggaaaagaaacaaaaagaaagattatagaaaaagcgtgaggaaagaaaaatctcagaagaaaaggcagctaagagacgggcagagaaaaaggcgcagttggagaagctgacagaagatgaaacgtttacaatatcagctactggcactgatgtaaaaagtgttatgcagaacctcttagctgcggtttctggtacatctgcgccgacaggggcaagttttgatataaaggcataaggagaaattgttcatattccgcaaggcgcataaacctttgcttttgcggactgcccggacttattgcaagggggcaggggcggcaatataaaaaattgatgacaatggagaattaggaaatggctattaatggagtcggacataattatgattatttgggaacgactacaaattatatacggggaaaagcaactgttagggaagcaatctcaaagatggtgaagcagtcggcaaatctttctatttctgatgcaggaagaaatatgctgcgggaaatggcaagcaaatttgaacccgattcggattataccaatgtcagggaactgacaatacaaaatacaaatgaggttgcttgggaacactataccgcaatgcgggatattagcagcctaacattaaaagacgggaattataatgttgaagatgtgatgaaatctataatggatacatatgaaacccgttataatgaaatcgtaaaagaacatgaaaatggagatcgtgaagtttcctacgaacttacggggaaaaggtcattgacacttgacgaagatttagccggattggacgaagcctttaaaatgcgtctggcaaatttagaaggatatattacctgtcaacaaaccaataaagcatttgaaaacgcagacagttcatggtatttccgtagaaatagccctcaaaatgaagtaaaaacacaagataaggctcaaatgtttgatacaaaatatcagaaaaccgcagtatcaataatggagcaggctaaagagaagtttttggtagcctttaaaagtataaattacaaacaaggaacagcaacaagcatactatcggatattatgaaaaagtgctgataaaggaggattaaaaatggctattagtggagtaggacagagttattatcagaacaatgttgcaacaacgaaaagtacaaagagcgtaaacagcacgggagaaacgggcaatacaaaggaattatcagaagcggaagaaatggcgattttcaaaaaggaattttatgctgaaattgataagatacccagaaatagaactataaccaatgtggctatcaacatatcagaggaagcatttaagaatatgaaagatgatccggagtacagggaaaagatattatcagcacttaaacgtgacttaacttcgtcctttgcaccgttggaagcttctatggtgctcactgtaggagctactgctaaagattataggggcgattcatggtctggtgttaataatcaatcggaattttttgctcgttcacaaaacagtttttataaaaagacaagcaacaagaaagatagacaaaaagagcttttggaagaatatctggaaaaacgggcgcaggttaaaaaacagcagcaggaaatgttgaatgaaaagattgcaaagcaggaacaggaaagaagccgattattacggtcgtggaacaatgaaaggctgttgtcaaaagcgtctaatgcttatgaagcaaatgctatgacggaagcggttacggatagtgctttttcgcttggatagtgattttaagtaaggagaaagagatatgtcaattacatttttaagtaatcctattcatctgccggaatttttcaagtttgatagggaatatttgggaaaacaggaaagccaaaatgaagaccagaaagtgtttcataaggatactttagaggtttctcaattatcgaaaaacagggaaaatttaatggataaaattaagcatacagttgtgcattcggttacatcgttcagcgatatgagagccggaatattaaaagaaattagggaagaaaaagggcagtatgactatactgatgttgtaaatgcctgcggattgagttatgcaaggctttattctgaaattgaggaacgttataaaaatggaaatgagcagtattataagtcagcaggtggtacaccatggacgaaagaagaaattgaatggctggatatgcaatatgagcaggaagtggcatggcagaaatcctgtgccagaatagcagcccggggataggtctttcaggggaatattcctgaagtgccaacaaaagagattgaagaattggaggacagcttttatcaggcgaaggatgcctacatcaagttatatcaagaaagcaaacagacaggtaagtttcttgttttgcaaaattatatgttaggtagtagccggatgtatgagatgctgaataaattaggaaatttacaggagagggtggaataatgcaggttaattcgtccaatggttcattacaacaaaggattttttcaggaacaggaagtataggcggtgtccatctgcccgattttaacgataagtatgtgttttccaaaaagaaaagcggtattagtgatgaagaatacagaaaacagattgtagcgcaggcttataaagattttgaaaagggtacatttcaaaataaatcagatggctttaacaaattgatgaaaaattatacatcagaagtatccccggatagaaagggaatcattacttctggattaaaagctgttttaagaaatagacataatgtgttaaagccgatagattttgtcgcaactctgcttgaggggaaagtaaagtatcagaaactgccatcgggcaatagtgagtacatagaattttatgataagaatggggagatggtagcaacttattccaacaatggatggacaatgtataccacgaatgcagaggcagcgaggcaaacagaaatgtgcatgatttataatgaagcatggggaaatgcaaaaagaggacttccgatagtaggaggggaatccgtaaatgaagaaaatttgaaaagcagttttgatgtcaaagcatagtgaaaaatagagtaatggaaattattgtgaacagtgtttctccgcttagtcgatggagagaatatacgcaaatttattgtaaatggtgtaacaatgtgattatggaaatttcgcactgcgtttcaagccggttgatattcaattcacaaaaccgaattgggataatattatgacgaaacgtgataagcctgcaatgtcggaggaagaattcgagaaagctataaaggaacttgcacagaaggaatttgccaccgggaagcgggatgatgcggcataccgaaaattatgtatgcagcatggtgagacagtttccccggacagaaaaaccatctatgaatcaagcatgagaaagacaggaggaaagatgaatgaggcttgtatgttttgggacaacaatgggaataaaacattgtcttacaatcctgaatcaaggaactggaaagccataagcacagaggaagaatttgcaagggcacgtgtatttacatctatctataatgatgaactggcacgcctgaaaaaggagtatggagaaaacgcaaagggaactgtatcttatcagcagatacagtctgacttggcagcgagcatgaaggcaccatctccgggcagttcactggatatacagatataatcctacactctattccgatgagatgcttaaagctttagctgcttgatttttccaatgtcacaggatgcccggaatatactgttaaatgccatgcatagcatattttgttgaagtttttctatatcaacaatcaactagcacaacgggttaaattatataaatatatttggaggaggttactatgagtaatacaattaatgtgaactatatgacacgggcttacaatcagtaccaacagaaaaatgcggctaaagatcaggagaaggaagatacaaggtttgcggatagtgtaagagaaaagagcgaagctagtggaagtatagtgggcaattcaaaaataggttctgtgtctgctaaagatatgacgatggtggaatacaagcagtacatttacaataaaatatctcaaattccaatgcaccccacaagagcaggcgagtcaatatctgttacaatttcagaggcgggttttgaagcaatgaagaatgatccagagtatgaagcatgggagaaagttataaatattattttgtaatggtaatatgcagctttgttcgtggaaatgtgatgtatattctgtcaaaattgatttcaaagaaagggatgcagattgctgcctttccgaaagaaattttgggtgtgctggttatggtatttacctttacggtgttgaactgttgctttgttattcttttgtcattggaagctggcagtgaaaaaagcctgcttatgtgtgccagtattgtaatttccattgtcctgacagattattttatgctgtatatgatggaacgttttaattatcttgtgcaaaaacagtatgaggatgcaatgtacagggaagaaatgcactataaagacatctattatgaagaagcagaaaaacagaataaggaagtgcagaagttaaagcacgatatgaaacataaattgcatgaactgtatcatctggtggaaaatagtgatgggcaggaactttcagagaaaatcggtgcgatgtgcatggaatttgagcagatagatgaaaagcggtattctgataatccaatcgtagattctgtgctccgcattaaattcggcagggcaaaggcaaggggaataaaagtagaaacatctattcgtattccaaggcagatgcagcttgatcacggggatataggtgtattgtatggaaatcttgtggataatgcggtagaagcctgcagcaaggtgccggagggacagcgttttgtaaagattgaaaataagtaccagtcggggattttgcttcttgtaataacaaacagcaaaacaggaaagaaaaataaaagcctgaaaacaaccaagaaagataatatcagacatgggcatggtgttcagagtgtccgtaaagtgatagaaaaatacaatggaacggtcagttttacagataaaggggatatatttgaggtttcagcaatgctctatggaattgaagtgaaggaataaatgcaaagcgttacacttaaatgtcaatctgttacactttgccgcattttcctgtaaagtatgatatagtgcattcatcaaatgcaaaggaggacatacatatatgtcaaaattaagaagattgatgaaccgactcagtcatggagcattaaccagcgtggcagcacttgcccttacggtaactgcaaccaatatgaaccgttgctgctggtttattttcggacaggacaagttaccggataatgcgaaaaaacttagaaaattttaaggtggtaacagggtatgattgctaaatttgcaaagaagataaatgaaatattgatacaaaaggagattgtgcaaaaagaggatgcagaactgtaccaatatgggatagaaaatggcattgttgttgcaggaaaccttttggcttctggaatatttggcattgtgacggggagaccgggacttgttctggtcttcctgttattttatgcctcgttgagaagctatagtgggggcagccactgtaagagtagaatcggctgttttttgatatcaatggcaattttatttattccggtttatacatatgagcctgtaatgaaaaatgttcctaatgccgtgattttattgatcggagttcttgcagtggtaattattattgtccttgccccagtggaaagtatcaataaacctcttgatgaggaagaaagaaagtattatgcaagggtaacacattgcataacagcattgcaggtatgtgttcttatcattttattttgtttggatctgcaagattatttttatgctgggtatgtgagtatagtcctgatagcagtatttatggttatgggaaagattgcagtgaaacgatatgtgcaatagcaaaatgtattaaaaataggtattgatatataattttgtagacgaacatggaatattacaaatatagagtaatggttaaaattttggatgaaaatgccgaaatataataaaaaataggaaaatatacaaaaaataatccaaccaaatgaaagaagtatgtcaaatttgtgtgtggaaggggatgagcatatgttcagaattgctatatgtgatgatgaaagacaatttagaaaacgcattcatgatattttaatagaatatatgaatgaaaatgatatattatacgaaattgatgaatttgaatcaggaaaggattttataagtttaggtatcaatctagcaaagtatgatattgtttttctggatgtaaatatggatgaactggatggaatggaaactgcgcagaaaataagaaaagtcagcaatgatgtttttatagtttttgttacagcatttattacatgtgcccctcaaggatacagcgtaggagctataagatatattctgaaaaataatgtaaattttccggaactaatatttgagtgtatggatgcaatcagcttgaatatgaattatgtagcccaaaagaagaaatttaactttaatgagggtacaaagattgtagcattagagcgtttgttatacatagagagcagattgcataaacttgagttttacattatggaggacaagttaaaaaaatattcaatatatggcaaactagatgagctggaaaaagagttgcaaggtaatgattttatccggatacatcaaagttatctggttaatatgaagcatattgagaaagtcagccggtatgaggcgttattgaacaatggtattaagttggaaattccaaaagcacgatataaatttgttgaagaaacatttgtttcgtataaaggagaattgtagatgctgattagttacattcaaagtattatgatgataatattggaggtaatatgctgcaaaatattttttgaaagttttgctgaaaagagatcaaaaaataattatagaaattatagtattattttaggaattgtggtatgtgaatatgtaatagcttcattattttatgataagtttatcttgaaacaaatattggctatagttgctgttgcggtgtttatgtgcttttattttaaaattcatttcggaaaagcaataatcttatcattattatttcaggcattgctgctttctgtagactattttacactatggttaaatgtttctctttttgatagtatagcagaaattagcaggttgcattttgtaggtggaagtttaataacggttttgggaaaaataattcttttcctagttgttttgcttatcaggaagaaagtaggaggggagtcctcggatgttttaagaagtacagattggcttcgatttatttttttcccagtttttacaatcttcacagttattgcattgatcatgacatctggaaacattgagaatcaaaagcaggaaaatgtattcttggttatagcattgtgtttagcagggatgaatatagttgtgttctatatgataaatgatatattaaaacgtgaaattaagattcgtgaaaatgaagtgtttcaactgaaagcacgaaatcagacagacatgtaccgttctatttcagaaaattttgttaaacaacggaaaaaaacacatgaatataagaaccagattatgtgcattgagtctttgatagagatggaaaattatgatgaactaaaggattatgtgaaaagtataagcggaaatttgagtacagagttagattatattaaaacaaataatgtgattattgatgctatattaaatagcaaatataaggaaacattggataaaggcattgtatttatctttcaaatcaatgatctatcaggaattaaaatgtgtgatgaggatattgttgttatattatcgaatcttttgaataatgcaatagaggcttgtgaaaagtgctcaggcaaaaaatttatgaaaatgaaactggttaaagagaaagacaacattattatatctgtaaagaatacatatgatggtaaacttaatattaaagatggagaaatacagacctcaaagaaatatgaaatggatgagcatggggttggaataaaaaatataattgaggttataacaaaatatcaaggctcttatgctatacgaaatgataataatgagttctacttctcagttatattgccaaactaagatgaaccttaaaaaagtgatttgctgcaagcaaatcacttttttttgtcattttctgcaaaaaaaggtcactttctgcaatggatattgttttgtaaacagataaagttatacttaatttggcaggaggcataactatgattgaaaaaatagctgatgatttaattggtcagatgactgaagcaaggttaattgacaaagagatggaagcaagatatgtttatgtttttatctgttggatagagaaatttattactgttggcagtattatcgtaatcagtttgatgtttcacaagctgctcccaactatattttttctcgtatttttcttggaattaagaaagagaactggcggatatcatctggacaagttttatagatgttatttagcatccattgtttcttatttagttatcgtgattataagtgaaaaattgtcagaacatccacaatggttatttgcaatagtactacttgctataacagggataggattgattggtacagcgaatcatcctaatatgcacatgacatcagatgaattgatggaatcgaaaaaatctgcgaggactattgttttacttgaggggtgcataatacttggctgtgttctgttagatgcagatatggtttacgttagttatatggcaatagctgttatattatgtgcagctttgctgtgtatagcaaaaatttttaaacaggaggtgaaagaatgaagaaggttaataagaaagtgttgaaggttgtagaacatgtcatgagaaatgaagctgtatatggaatagatagattcccacctgcatgcatgggaatatttcatcagccgaaacgtccgattatccagaagaaaagtgaaagatagttaactggcgtgttttactattatatctgtagccatagatgctataggaacttaattgtttattccaagatgacaagtataaaaaggaggtactgatatgttaaaaaaattaagaaagttattgcatttgcattagcattgactatgttaatgggtatgggaacaatggtgtcagcagcagaaaaggagagtagtattcctgaatattctgaaaccaatgatggtggaatgacggtgaatattgcaggagatcaggaaggaacaatagttgaaggcagtggtaatgaggaagggattaatccgctatggtggcctggagatggaccggctccgcaggtgacaagcatttcactttataaatatggctggcttacaaatggaaattttggcgttacgatcaaggtatatggatatggcagcgatactacaacatttgatggaagaagtatttcgtggatacatcaggagccatttattatatctggtacaggcgcagatggcttctattatacatatgattgtggtccgattacgcaagcgggaagttatagatttaatacaactttcaggtcaacaaacttccctaatactacacgttccttttcaacggtattcacgtttagtgcaaactaatatatgttaattcatataaataacatattataatgcgaatggaggtggttaaatgcgtattggttcgggagtgcagagtgtatctgaattatttggaaagcgacaaaacaatagcaaaacatctgttaacggaaatgaggcatttcctcagacatcaatgaaagtgtatttaaagacggatgatatgttgttttcaggcggaaatggaaccggtctttcgttttatattaagtatgcagaagagtcaacagatgataatcctgtagtgatagccaaagggattgatgaaaatggaaaagaatttgaagaaaagattaatattaacgatattgatttgagaaatgcttcttatgtcgaaatgagtgctttggaggcatattatgatgttgataggggtaatagtctcagctcttttccacaagaaactggtcacatgggattaaatgaaagatgtgaccttatatccagctttgaaaaggttattcaggatatgaacaaattaggaaagtatgatttgcagatgttttatatgcgaaatatgaatacttatctaaatctggaaagacagaaaaaagcataaagttgtttatagattcctgttggaatgaaaatttatacgatgttaatttgaaaggagattttaaaatgaagaaagtaaaaagtttaaaggcgttggtgttgagtttgatgttatgtttggcaatgggaacaactgcgtttgcaagtgaagtatccactcagggacaggctgcccctaatgcaaataaggcagtagaagtaagcgattgtggcgatttggacgtagtacctgcttatgatgacgccgttgctcttgcagatacgattcagtatgatgcaaatagaaccattacaagaagcaattccagaagcggtgtattcaacggaaattattattacaccattaataactcaagcgttacaaagttgtgcttaaatgtttatatgcctaatgaaagtggaacagattatcttcagggaacaattactcttgtaggaaatgacggaacaagtgcaccggtacaaattgctaactattcaggagattcatggacactgacatttacaggtgttaaggtaggcgttagataccatttccattatgagttgtattctgttgggtcttcgcaggtaggctatattgcttctgctgcttatgcacaataatagctgcttgaatatgggatattaagcaagcgcaacagaatattttcattgtatgttgcattttatagcaatctggcataaagtgcaacatactataataagaaaattagattatattgctgctggagggattataaatatggtaaatatggtaaataccgctgtaaataacaatatttacgcaggaagaaaatcaggttcaaaatataaccaatcaaaggcttttcaacaaaaggaagtgttagagacaccggatgttgcagcagttaacaaatatgcaaatgttcaagaaatttatgaggcactaaagtgtaacgtgtcatgtagaggatatgaacaggggcaggatgaaattgctgagaaagaaattcaaaatgatgaaccagaaataagcaatgattccagtgaaaaaatgacagtatggtatcagggtgttcctttggaagagtgggcattaactgatcctaaatacacggattcagaaacgggaatttcatggtatattagagatggaaaatatccgtatatggtaggtgaggatgcagaaaagttccgaaaactttgtgaagaatccggggagtttgcgctaaagaaatttgcggaaatgacgggattaatacagaaattagatgacaatacagtagcgtatgtgggtgataacggaattgcagttaaatctaaagatgggaaagagatgtttgtggacacatcaggcttatcatatgatattgttatggatatgttcagaaatttgcctagaaatgggaattttttcagcaataagtattggtcagacaatatacagaaagcacaggctcggagctgatgatacgttatattgcaagagtgtgtatgcttggactccgataggagaaagcagattggttctgattgacagaagaatcatatgatttcatcattaatttggcaggcaataatattcaaattattgcctgctaaatttttaccaaaattcttctaataccgtttttagactaggaaatattgttgaaagcgtactctcaatatattctttagagcagaactgtagctttgaaatagtatcaatgctgtgttttttacttgatttctgagtaatttttgttctgttggtcattttctgcaaaaacaggtcactttctgcataggatattttcttttgctttgattcctgctattcttagaatatacaacagattgctctatatggcacattgaatactgaggaaaggagaagtaaatataattatgaatatgcttatagaatgatctgcatataacgacaaaatgatattaaaatagggggtgattttgatgaaagattttcatttgaagattttagctataataatgataatttttggcatatttggtttaagtacgcttccgtttctttccattattgtccaatatattgactcaataactggatttagttcaggaaatggatatcttaccaataacatggattatctttttaaaagtcctcttatttatattggtggcttttttgtttttagtatcattttggcaattatttatctggtttatagtttttttaaagcaaagcgggggtgacttctaatgaaaaaaataattagtatggttttaagttttatattgattttggggtgctcgacaacagcgtttgctgcggagactcataactatgacactgaaaatttgcctcatgatggagctgattattttgaaacggaaattaaagctgatgaggaaaatgaagaacgcatttctgattttgttaccgtatatggttatcaatataccaaaggtagtttaaaaagtggtgcatggagaaatggcacgagtggtggtagttctacatctagcgcaaaattatcattgaattacactcaagatacttcttataatatttcctttaaagcttcagtttccggtggatatacaaatggtggaactataggaagtgagttgggtgttacactaggtgcatcaaaatcatattctttaggtagcggatactccgtaactgttccaaaaggatctcattatttaatcaaatatcgtcctatgtattatacatataaggtcgttgagacaaaatataaagaaagatataatgaagcattaggcggcatggagagatatgtggttgaaacaaaaacctgctatgtagacgtattttcgcactgggattttacacatgtagctaagtaaaggtgtatgttacactaaataaaagcagggaactatctatatccatgcttcaaactggagataaagctcgtggatctgccacgggcttttctcatgttgttatatacattttgctgaaattttaaatttcagtgtaaaagtagattggtgtttagaaggaatatgcaaagtattacacgaaaatgtcaaaggattacagtttcctaaaacccataataatttctgatataatgcgataagtcagaaaggatgatggggctatggggaaaagagagcacatatacgaaattattgcagagaatatcagaaaagaacgcagaaggcttggaattacacaggcagagcttgcagaacgggcagatgtatcattggatactatcaaaagtgttgaaaatggcagaagggcaatgagtcttgatacatatttgaatattgttcatgcattggagtcatcgcctatggttttgatgagccagcagcacccagaaaaacacattgagcgttttgcatttatgatgaatcgatgtgacgaaagagaaatagaatttgcattacatatgattgaacaaatattaagaggacaggaagattatctgagtgaatagacgggtagttatcctgtcctttgtctatgcttttgcaaatttttcagcgagatggtatatgatttcttcaatggtgggagtatcattttcacatggaaagtctgtccagaagcgttgcatttttggatcagggctttttaaagcaatggaaactgcccgcccaatttcctgttggacttcttcttttgtgattccttctttttcggcaatgatttccaaatatttatcaacagagtatgtgtttttatcattcatagtgttgttgtgaatcctttctgagaagggtatttgcggtcaaattgtcaggtgcttgaattgtcccggttgaataccataaaagtaaaacagataatccgttctatattacataataaccttgagagctgttttctatgcagattatggctattttctattctatcatatacatacagtatggtgcatacacgcaccatatcattataggacactcttgcgtagaatacaaggaggaggtctttgtaatgatagtatatgacaggttatggatcacactcaagaagaaaaatattagccagtatgcactaattaaagattatggaatagataaagcacagttacagcgattgcgaaagaatatggtcgtaaaaacggtaatccttaacagattatgttccatacttgattgtaagatagaggacatcatggagtttgtgccggatgaggatattaagtaaagagatatttccaaaatgtaatgagagtttggaaatatctcttttttaatccgcaaatatttatattcttggtattaaggtgtacaatattccacctgaaatagctggtttagtcactcttacaaaagattcgcttacggtacaatgaatacagcttaagcaaatatataaggtgccggaaaagagtggaaggtgtactacgatattgttaatagtggagaaagaataaaagagttgcgtgcggcaagaagaatgacaagacagcagcttgccgagcagattggattgtcagtggatgctctgcggaaaattgaagctggtgtaaatggagcaaaaatagatacgctgattagtattgctgaattgtttcatataacgttggattatcttgtgtgtgggtgtgaaagaaaggcagaagtcgatgatctgctggttggtctgaaggagaaggaagtacagtttatccggaatatggtattaaatgccgttgacaatatgaaacttctgacagaataaaaaagtcggattgcatttttgataatgcagtccggctttttttataaggatttggaacaggtgggagtgttactcttagttcaaaagagtgtcggttactgtagaagatgcgtggtgtcagttatactttgttcaggttctgagaaaagagccgttgaatattgaaaacagaataggacacgcatatcccacgagcttatatcgccttgtctatgacagggtggcagaatcccatttcgtgcgatgactatcctcagagctgtagccgattatgagaaacgtaacagcaggagcctttaaggataagagcagagggttgtgcctaccgggttagcagccggaggtaatgagataataagtgcacctgaatttcagcaaaacgcattttcagagagtggctactttcgtaagtccagatgggcaggaaactacgaagtgattgtggctggcaaaggatatgttacccgatacggggatggttaagaaaccgggaagatagtattttatcttcccacacaaactgatttatggtcaccgacagaaaagaaatgtttaggtgtgatggtgtggagagtacagataagtcatcttatgtgaggagataaagtgcgcacagtatcaaatcaatattatttataaggagattttaagatggaaagagcaattatatattgtgcaaaaacaggattagaggctacagatcattttgtgccggagctgcttgaaaagtattgtaaggataatggctatgaaattgtagctatgctttcagagcctgcttctacagaaggagtttcatttccgatgaaatatgcctttatcggtttaaatatggaggaagatgttaatacaatcataacactttcaaaggatatgattggtgcaacagatgagaccgttattgatacacttggaaaactcagcgaatatgatatctatgtggaggatattaatggagaacttgaagagtgttatgagatgatgtacaaagagcctgttcaggaaagtgatataagagggctggtgcttgatacggtatcaatgttctatcataacatcagggacggcagataggaggcaatatgcaggattccagagaaaaaaagcaatgtctgatatttgtaaggaataatgcaaatgatacagctgaccgtatcgaggcatatgcaaaaaagtccggcatgaaagttgttgagacaatttttaatacagataaaaaagcggttgaacgattaagatattatattgaaagagatgtcattatctgtgtgctagtaagagatgtggtagacatttcaatggaacttaatgagattaaagctgtaatgacacttgcagcggaacatggaatcagtattaatgcagagagcaggggctatgaacctgctctcatttcttatgaatgatatgacagaagaaaatagaaaattaaaactgattatatttccgggcgaaacagtagtgattgatgaatatgggaaacggattgttgcctgtccgacagaggatgaggcagaagaatatatcagggaacaggaggaatgacatagatgaaactgaacaggggcgacattgttattgcaaatctggagtcagtaagtaaagggagcattcagaagtatacaagaccttatattattatctcaaataacaaggcaaatcagtattcaccggttgtcacagcagtagccatgtccacaaaaacatggaaaaagaaatatctgccaacccactgtccaataccggctgcaaaggtaaaggttactgacacagattttgaggtatttgacagtatggcattatgtgagcagattgtatccattgatgtaaatgtccatattgagagggtagttgcttcaatttcagatacggaactacttgataagattactgaatgtgtaaaaatccagattggggcatatgaaaagtacaattaaatattaccggggcatttgctccgggttacatagccacctgtattctatgggtggcatttttactgaaagggggatagattttatgacagcagaagaatacagagcactattagatgtggattttaacaatgtaaaaatagaagatctgactgatattagaaaaattaaaatagataaaaatcagccacagagtaagaggcaggcacagttcttaaaacaggtgggaaatccatatatgctgcgtcgtggaagtatgatgattaaggtaagctttgcgaataatggactgtcgatggaacaggcatttgaaaatctgcttttgaatgtctgaaaatttgtggtggaatttcaaagtgatatgtgctatgatgtttttggtataaaaattctaaattagtgcatatcaccttattgaaaagttatcttctaacttaaacaacaataggaggatgtgcatatgagtcagataagtcagatcaaaaagatctatcatgcagccatctatgttcgtttatcgaaggaagatggcgctgttgcttcacatgaaaaaactgagagtaacagtatcgcaaatcagaaatcactgattagagattttctcgaaaacaaaaatgatattgaggttgtgcaggagtatgttgatgatggtttcagcggctctaattttgagcgaccggcattccagatgatgcttgaagatattaagaaaggcaaaattgattgcgttgtcactaaggatctgagcagattcggaagagaatatatagattcaggtatgtatattgagcgattattccctgctatgggagtaagatttattgcaatcaatgatggtattgattccggagaggcaaagtcgcagtcagatgagattattattccattcaaaaatcttattaatgatgcttactgtcgtgatatttcaattaagatacgttcacatcttgaaattaagagaaagcagggagatgtaatcacggcatttgtgccatatggatacaaaaagaatgataaagataagcacaaactggaaattgatgtatatgcagcaaatgttgtgaaagatattttcagaatgaagttgcatggaaaaagtcaggatgcaattgcatgtgaacttaattcatcaggaatacttccaccggctgagtataaagcaagcacaggaagcaattatcagacatgctttaagacaaaagaaaagtcggagtggacttcagtcatggtaaggagaatccttacaaatgaggtttatataggtaatctcgtacagggaaaacagacaacaccgaatcacaaggtcaaaaagaccataatcaaagaaaaatgcgaatggataaggattgaaaagaaccatgagccggttatcacggacagggattttgaagtagtacagagattgcttgcaatggatacaagaacatcaccggacagagaggaagtttatccgctgtcaggggtagttacctgtggcggctgtgggattcccatggtaagaaaaacttcaaaagtgggtggcaaaacttatgcctattatctgtgtgcaacccataaggattcaaagcagtgcagttcccacagaatttccacggataagttggaagaagtggtgctagagcttttacagacacacattgataacatgattgaccttaaaagaattctttcttttatcggcaacgtgccgtttcagcagcttgatatgaaaaagcttgaggaaaggcgtgaaaagaaacaggcagaggtagacagatgtgcagacctcagaggaatgctttatgaggatatgaaggatggcattatctcaaaggaagattacaaagagcttcatacagcatatgagcagaggaaaaagagtgccgagattgccattcaccagattgaattggaaatggaagatgtgctgaatcgtaagagcaaaggctttgtatggcttgattattttacggaacataaaaatatcgagaagcttacaagggaagtggttgtatctcttatccgtgaaataaaggtatttgataaaacccacattgaagtagtgtttgactttgatgactgctacaaagaatgtcttaatgttattgcaagtcaggggcattcggttgaggtggacagtacaggaaaactgaatatcagattaaaggaggctgtgtagtatggcaagaaagagcagaaaaaatatgccggttgcagttgcagagccgactgacaatctgacggcaaaagcagttttaagcatggataaggaggcaaaaccatatcaggttggaatctatgcgagactttcatttgaatcagaggcgaataaggaaagagatactgtagacacacagatagcatatatcagggaatttattaattcgcaggatgatatggtagaggttgaggtctatgccgatatatcggtgacaggaactacttttgaaagaccagaatttgaccggatgattcaggatataagggctggcaggattaatactgttattacccgtgaccttagcagacttgggagaaattatgtggaagcaggcaactacattgagagggtatttccttttcttgatgtgagatatattgctatcacagatgattttgatactgcaagaccgggaactgatttatccgtaccgcttaagaatattgtgaacgaatattattccaaagacctttcaaagaaagtagagaccggaaagcatagtatttgggcacagggcggcttcagcgagggaacgccaccatatggatattacagggctacagatggttcaagaaagcttttgattgatgaagaggtatctgacaatgtagttagaatttttaatatatttttggatgggaagggatatgctggtattgcaaagactttgcaaaacgaaggaattctttcacctccgaaatacagattctataagtcaggaaagattgaacttgctgaaaaagcaagagaatggcactattcgcatgtaaaagagatactccaaggggaatattacattggaaatattgttcatggaaagcaaaggaaggctcttgataccgggagaaagaatgttaaaacagatgcatcaacatggcagcgaatagaaaatgttcatgaaccaataattgataaggacactttctacaaaacaagggagagaatggagcatatcaaaaagaagcatttagaagcatcaaaacctaaagctgatgttccaaataagccggataatattctggtatataaaacaaaatgcgcctgttgtggaggcagtgtattgattggcaggcatcacacttattcagaaaagttctattataagtgtaagaaccgtagaaaattagctaggctatgtgaaaataagtactcttatgattattctgaggttatggatagtgttttttctgttatccgtcagcatatgagtttgtgtgttgagaaaacaaagtttgttcagaagatgaacagcagaaaagagaatgttcttcaatatgatatttataccaagcagatagcaaaacttcaaaatgatgtaagaagaattaccgctaacaaaagtggtttgtatgaagattatagggaacagttaatcactgcggaagaactgtgccagtatcagagagaatatgaaagcagagtaaatgagattgaagcgcagattactgaattgcttcatcgaagaagtctgtatgaaaaagaatttcatattgatgaaggatgggaagaaactgtcaataaatatatggctaaaagaaaacttacaaaggagcttgtggatgcttttgtatcggaaattgttttttatgatggcaatatagaagttaagctcttgtatgatgatttcctaaaggagctgcttaaagtggcagaagaaagagaggtgagcagcaatggataagacgatagctctctatatgagattatcagatgaagatgacaacttggctgctcatgaggaaagtaacagtatttcccatcagcgaaagttaatgcttgatcatatccagaaactgcctgaactaaaggactgcaacataatggaattttcagatgatggatattccggagcagactttagcagacctaattttgtaaaaatgatggatctggtaaaggctggtaagattcaggttattgtgacgaaggactacagcagactcggacgagattatcttgaagttggtaactatatggaatgtatatttccggttcttcaggtaagatatatcagcgtgaatgataattacgattctgctaacagctttggttcaaccggaggtatgagtgttgcactgaaaaatcttgtgaatgcattgtattgtaaggatgcatcaaaaaaggtaagagccgctaaggcagtgttggctaagcagggaaagtacattgctgcatttgctccttttggataccagaaaagtgaagatgataagcatatgttagtgcctgacccagtaacagcacctgttgtccagctgatatttgaactggctattaaaggcatgaaatacaccgagattgcaaattatctgaataataatggatatgatagcatatttgagtattaccaaaagattggagttaagagatgttatgaaagggatattggtgagcacatgtggagtgccagtacagtaatggagattttatataatgaagtctatattggttctgtaatcaataacaagacggctgataatattgataccggtcatcaggttgtgcagagagataaagaggactggataattgttgaaaactgtcatgaaccattagtttctgtggaagacttcaagcttgctcacaagatgatagcaagacgagaagtgacgaagagaaaaccaaatggaaagtggcgtaaatcgtatattcgctgtggaatatgtggtaagggactttataaatacggaaataaatcctcatacagatgccacaacggtcatgtgtcacgtattagaggtgaagaacttgaggcgacacttctagacattgctagaaatatggcattggctcagttgcaggaatttgagttgaaaactgatggcggtaattgtccagataatcttgaaagggaaatcgaatctcttaaaaagtcaaaggcacactatgcaaagctaaagtttgagatatacgatgattatacaaaaacaaatatcactcgtgatcagatggcaaaaaagactgcagaagttaagcagaaaatcgcagagatagaaagtctgattacagagaagcaggaaacacttgatatgcaaaaggatctctttcttgatgcaaagcaggaacagctaacaaagcttagtaagttggatgagtttgatgaagaagtaatcagatatctcattgattatgtgttggtgtatgataatgagcatattgaaatcagatggaactttgatgactttcaggctggatgatggtataatcagtagtaatagcgagaaaacaaaattataaagaagtaacatggggaatcttgctaaaggttccccattgataaaaaaaattaatttttttttgtttcttacttgacacgagcagaggttcaacgggtgattattcgggaaaatcaggagattaagcttacgtatacggagtttgagattttcaagcttcttgcaaagcatccgggaatagtgttcagcaaggaacggatttatgacattgtgtggaaggaatcatattccggtgattacaacatcgtcatgagccatatccgtaatattcgggagaagatagaggataacccaagcaagccaacctatatacagactgtttggggagtcggctatcggttcaataaaaatttaactcccttttcgaaattgtgtgtctgaatgaaaaacatgtataattctgcatttttgatgtataaatctacattaaggttaatttaaaaacgaatttgtttgaaatttcaccaaatcaatggaggtgtttgattatgaaaaaaagaataattgcagtaattgtaattttagctgtattagtagctctattctttattggcacaggttttcaaaaaagaatggatgtcgtattagttgattactctgtatcagaggatggaacggagatcacgcttgatgtaggaattccaacatcttcaggatatatcagaggatttaaagacaatggaagtggagtaaaaccacattatcttacatttttttcgacatttggtggaataaacagtccgattggagcagagcatagcttccaattagagcttacttcggatgatacagaaatttattttaacagaccggagggaggttacgagttgattttagtgaaagatgaagaaacaggtcaatggctcagaccaagtggaataggtgaagaaaataacactatttttgaagcaaccattcttgaaattcgtgataattattttttagtagaaccagtagagggtagtcaagaattaaacaatgcagatctgattacagtaccaatgaaaaacataggtactgctccacaaccaaatgttggtgacattattgaaatagcatataacggagaaattgcagaaagttatccagcacagataacagaggtttacggtatcaaagttgtcaaagaagcagaacaatgggatttaattcctatggtcatggtaaatggcgagttatatattgacacaggtcatgaaagtacagtagaagcccgttgtggtgttatggatggagagattacgtcagaagtagacggaagtgaaaagccaacaaaagacaatcaatctaactttggtacgggctatggatatcaatatggttcacaagaaggcataatcgagattaatatgaatgaaaaatggtgggtttttgcaacagaaaaagtcctggccagtagtgaacttatgatagacccagttgcagtagtaagtattcataatgttttcacaggagaaaatgcgaacatcactgaaaatgaggatatcagaactatatctaatatattatgtggtgatgcatggaatacagaaggtacaactgattgtttaagcaacattgaaattacaatcaacgaagaaacatacaaatatcattccgattgtggtacattcaacgataatgtaaatcagaactatttatcactggatgacgaaaggaaagctgtggtaaatgccattttttcagagtatatatcactcacagccacagaagttccagcagaataaattttacaaaggctacccggtcaaaaaaattggatagcttttattatgttttaaacctaaactcaatttcaatccagtcagcaaaactaatctttatcatatccaagcaaatcaatagctcaaattgcattaacttcttaaaatgtataaataacaggatagtttgggttaagtaatatcagaaacacttttccgaaaagggagaaatttaatagcatagaaacagacaattaagaaacaaaaacaatggcagacgctaaaacagaaaaacagaaagtacaggaaataacggagaagttggagtagggtatcaaggaactttttgaaagcgagaagtacaagatttatctgaataccatgtcaaaatttcataattacagctttaacaacacaatgttaattgcaatgcaaaagcctgacgctacgttagtggtcggattcaaggaatatactttgccgaataaacaggggggacgataatgcaggatgttatgaatgttaatcagaaagaatataaaattgtgaagttattaggacatggaaaaggtggttattcctatttggcagaacgggaaggtaaattttatgtgttaaaacagatacaccatgagccatgtgaatattactcatttggcaataaaatcgaagcagaacaaaatgattataacagactgttgcagacaggaatcagaattccaagaatgttagacattgatgtagcaaatgaaagaatattaaaagagtatattgactatgaatgtaacaattacatggatgaatggaattttgaaaattgggggattaagtactggtctaagacaacggaatttattgattatatggagcagcattagttatgtaactcaagattttgttcaatccaaatctcttataatcctcaaaacttgttgattttacacgaaaaaaactatactatagatagtacctattattagagtcagagcgtagagcagaaaaagatacgaggaagtaatgatgagaacagaagataaaacaagaatgacagagggaagcatttccagaaaaattattttatttgcgattccgctgtttcttggaaatttgtttcagcaattgtataacacggcagattcactgatcgtaggaaattatctcggcagcaatgcgttggcggcagtcagctcatccgggaatctgatttttctgatggttggatttatcaatggcatcgcaatgggtgcaggtgttgtaattgccagatattatggagcgaaagacagggcaaatctggagaaatcaatccacacaacggttgcgtttggaattgcagcaggaattgcattgacagtgatcggcatgcttttagcaccgaagatcctggtgttgatgggaacacccgcagaggtgcttccggagtctatcacctatttccgcacttattttgcaggctctatcggagtgatcatgtacaatatttttgtagggattttgcagtcggttggagacagcagacatccgctgatttatctgatcatttcttcctgtatcaatgtggtgctggatattttctttatttcaggattggggatgggagtcggtgcagccgctttggcaacagcgatttcccaatttgtaagtgcattcttatgtctgatccatcttctgagagcaaaagaagaatataggcttcagttaaataaaatccgttttgacagccagatgctgtggcagatcatacaaaacggtgtgccgtccggttttcagaattctgtgatcgccattgcgaatgtttttgtgcagacaaatatcaatgcatttgggaaaatggcgatggcgggatgtggatcttattccaaaatcgaaggatttgcgtttctgccggtgacctgttttacgatggcgctgaccacttttgtcagccagaaccttggtgcaaagcagtatgaccgtgcaaaaaaaggagcgagatttggcgttctctgttcgattatcattgcagaattgatcggagttgtgatttatacagccgcaccggtgcttattgcagcctttaacagtgaaccggatgtagtacattatggagttatgcagtcgagaaccattgcattgttctattttctgctggctttttcccactgcatcgctgcggtgcttcgtggttcgggaaatgcatcggttccaatgatcgtcatgctgtgtgtatggtgtctgttccgtgtaagctatatcacggttacggttcattttatcccggatatccgcgtgatcttctgggcgtatccattgacctggagtattagttcggtcattttccttgctttatttttgcgtggaaaatgggtgtatgggtttgaaaagagaaaataagcagcatatccggcgtaggggaaaagcttgacaatttcagctttacgtctaaaataatatcatatgaatttgaatgagactgatgcataaaagaatgtatcagtcttatcttatgcagaggagaaccggaatttatgaaaaaaagtggaaccatgaaaaaaatgctcacctattataaaccttacatgcgtgtgttctggacagacatgttttttgcaacgctctctgcggcggttgccctgatcattccgctggtcgtgcggtatgtgacctacaatcttgtgtaccgtgagccggcagaaattttgcatcaggcagcatacattgccattggactgtttgtgctggtggcggttgactgttacagtaaattctacatttgtaattatggacatgtgatgggagcgaaaatcgagtatgacatgcgtgcggaaattttcgcacattaccagaaactgtccttttccttttatgatgaccagaaagtcggacagctgatgagccgtatcacaaccgatctttttgatatcagcgaactgatgcatcatggacctgagaacatcattctgtccgtgatcaaaattgccggagcactgatcattcttgtgaacatcaacccaatgctcgcagttgcagcctttgcaattctgccgttcatgctgatctatgcatttgtcctgaataaaaaaatgcgtctcgcattcaaacagaaccgtgtaaaaatcgcagacatcaatgcgcagatcgaggataacttatccggtatccgggtggtaaaatcttttgccaatgaagagattgaaaaccgtaaattcaaacaaggcaatgacggtttccttgcagccaagaaaaacagctatttttacatgggaagttatcaggcagggcttggagcgtttacgacactcattcaggtcagtgtgatcctgacaggtacggtgctgatcgcaaaaggcagtgtggatgtcagcgaccttgtcacatttatgctctatatcagtgtgtttacggatccggtccgcaccctcattgatttcacagagcagtttcagaatggttataccgggtttgaacgttttcaggagatcctcgccattcatccggatatcgaggacaaaaaagatgcagtggaacttaaggatgtaaagggagatattacttttgaaaatgtttcattccagtatgaggaaaacacggaaaaagtgttgaatcatatcagtttaaatgttccggcgggggcttacatggcattagtcggttcctccggcgcaggaaaaagtacgctctgttccctcattccacgtttctatgacgtgacgggcggcgcagtaaaaatcgatggaaaagatgtccgtgatctcactttaaagagtctgcgcgaccacatcggcattgtgcagcaggatgtgtatctttttgttggaactgtttttgacaatatccgttacggaaaaccggatgcgacaagagaggaagtcatcgaggcagcaaaaaacgccaatgcgcatgagtttatcatgtcacttccaaacggttatgagacggacatcggacagcgcgggatcaagctttccggcggacagaagcagcgattgtccattgcaagggttttccttaaaaatccaccgatccttatttttgatgaggcaacctccgcacttgacaatgagagtgaaaaagtagtacaggattcattggagaagcttgcaaaaaaccgtaccacgtttgtaattgcacacaggctttccaccatcaaaaacgcagagaagatcattgttttatctgaggatggtatcgaagaatcaggaacacatgaagaactgatggacaggaagggaacttacgaaaagctttacaatatgcagttccacaaataaaatgaaagcagcagaaaaagaggagaattgatatgccggaacttatccgtaaaaaaaagaaaatgtcatcgtttgagatgatcgcatttggatttgcaggagtgatattacttggagcaattattttaatgcttccgatctcatcttctgccggagttgtgacaccgtttgataaaactttatttactgcgacatcagctgtctgcgtgacaggacttgtggtcgtggatacaggaagctactggtcggcgtttggccaggcagtgatcttacttctgatccagaccggtggattgggagtcatcactgtggttgcatctttttcaatggtttccgggagaaagatctcgttaatgcagcggagtacgatgcaggatgcgatttcagcaccgaaagtaggtggaattgtccggcttacgaaatttattctacagggaacctttctgatcgaactgatcggtgccattctcatgcttcctgtattttgcagggattatggatggaaaggaatctggatgtcagtcttccattcggtatcggctttttgcaatgcaggttttgacatacttggaacgacggaacagacatttccatctctgacaggatatattgccaatccattgatcaatattgtgatcatgcttttgatcgtgatcggtggcatcggatttctgacctgggatgatttttgcacaaacaaatggaacttgaaacgttaccgtctgcagagtaagattatcctcgttaccaccgctgttttgattttactgccggctatttttttctttctgagtgatttcgccggattttctatgggaaaaagaatactggcttctttttttcagtcggtaactcttcgaacagcaggatttaatacggcagatcttggtgcaatgaacgattcttccaaagcgatcatgattttgatgatgctgatcggtggatctccgggatcaacggcaggaggtatgaagacaacaacgatcgcagtgctgatactgaatgcatttgcaacatttggaagagagccggaaacagaggtttttggaagaagatttgataacacagtggtgaaaaatgcggcaacgatcgctattttgtattttttcctgttttttgcaggaggaatcgcaatcagtcagatagaacatgttgcattatcggattgtctttttgaaacagcatcggcagtgggcacggcaggacttacattagggatcacaacggagcttggactggtatcacatctgatattagttgttttgatgtatcttggaagagttggcggactgacacttatatatgctgcaatttcagtaaaaatccagagtggggcaaaaagaccgcttgataaaataactgttggataaaggagaaaattataatgaaaaatattttgcttatcggactcggaagatttggaaagcatgttgcataccagttgaatgagcttggacatgaagtgatggctgtggatgagaatgaaaatcttgtcaatgaaattcttccgtatgttacagacgcacagatcggtgacagtaccaatgagaattttctggagtcgcttggaatcaaaaattatgatatttgttttgtgacaatcggaggcaatttccagaattccctggagacaacttctcttttgaaagaacttggcgctaaaatggtcatatcgcgtgcagagcgggatgtacaggcaaaattcctgcttcgcaacggagcagacgaggtcatttatccggaaaaacagatcgccaactgggcagcgatccgctatacggcagatcatatccatgattatattgaagtggatgattcacatgctatttttgaggtggaggtgccgggaggctggatcggaaaaacgatcggtgaactggatatccgtaaaaagtacagcatcagtattctggcgatcaaaacagacggaaagatgaatatggcgattggtccggatatggaactaagcagtgaagatacccttttggttctcggtacatacaaggatatgcagaagtgttttcggatataatggataaaaataaacagggtataaaataattattaaaaattgcacaaaatttgcattttataaaataatcgagtaaaataggaatgttcgggcagaaagtgtgatccgggcagacaaagataatacaatgtaaccatgataatctgcattctgcatattatcaagacataaaaaggagtggatttattatgacaaaaattgatattatttccggtttcttaggagcaggaaaaaccacatttattaaaaagatgatcgatgaggtatttaagggtgagaagatcgttctgatcgagaatgagttcggtgaagtcggaatcgatggcggtttcttaaaagatgcaggaattgagatcacagagatgaattccggctgtatctgctgctcattagtaggtgatttcggaaagaatcttcacgaagtgattgataaatatcatccggaccgcattctgatcgagccatccggtgtcggtaagttatccgatgtcatgaagtctgtgatcgatatcgagaaagaggaagacgttaaattaaacggactcgtaacagttgtaaatgctttaaaagcgagcaagcagatgaaagcattcggtgaatttttcaataaccagattgaatatgctacagttgttgtgctgagcagaagccagaatgcaacacctgagcagttagagctttgcgtaaaacagatccagtcactgaatcctaaggctgcgatcatcacaacagcatgggatgcgatcaaaggagaacagatattaaaggtgatcgagggagcagattctcttgagatgaaattaatggctgagcagcatgccaaagaagaggcagcggagcatgagcacgaacatcatcatgaacatgatgagaactgcacctgcggatgccacgaccatgagcatgaccacgatcatgaggaccatgaccacgaagatcacgatcatgagcatcatcacgaccacgaccatgaacaccatcacgatcatgaagaccatgaccaccatcatgaacatgacgaaaactgcacctgtggatgccatgaccacgatcatcatcaccatcatgcagatgaagtgtttacaagctggggcaaagagactcctcacaaattcacgaaggaaaagattgaggatgtattaaagacactctgcgagacagatgattacggaacaatcctccgtgccaaaggaatggtagaggatgagaatggttcctggatttactttgacatggttccgggcgagtatgaactccgtgacggtgagcctgactatacaggaagactttgtgtgatcggctgcaacattgacgaacacagattagaagagttattcggaatttaataagggagaatatatatgaacgaaataccagtatatttatttaccggttttatggacagtggaaagacctccctcatcaaagacaccttatttgagcagggctttgcaaaagagggaaaaagccttgtcatctgctgtgaagacggcgatgcagagtttacggatgaagaacttgaaaaaaataatgtaaaacttgtcatggtagacagtgaggcagattttacagaggactttttgaaaaaagtaaataccgagtaccagccggagcaggtattcttagagtacaacggaacgtggcagatgggaacactcatggatatggagcttccgaagcattggatgatcgtgcagcagcttgccacagtagatgcaacgacattcgatatgtatcttgcaaatatgcgcacgatgatcatggaacagcttttttccgcagatgtcgtgatcttcaatcgctgtgatgacagcacagacaagggaaaataccgcagaaatgtcaaggcattaaaccggaaagcacagcttgtctatgagcgtgcggacggaacacttgatgagagaccggaggaactgccatttgacattactgcggatgagattgaaatttccgatgcagattacgccatctggtatatggattgtcaggagaatccgaaaaaatatgagggcaaaaaagtttctttcttagcacttgtatacaatccggacaaactgaaaaaaggaattatggttccaggacgtttcgcaatgacctgctgtgtggaggatgttacctttatcggtttcaaaacgaaatacgacagggaagatgaaatacctcacaaatcctggatcaatatcacagcagaagtgcatgtggaatttgcaaaagagtacaagggaaaaggacctgttctttatccaatctcagtgacaccggcagaaaaaccggaagatgaacttgtatacttttcataaacataaaaaaggtgttgacaaagatacgttaatgtattaaagtaacaccataaagaaaaaccgttgagaaagagtagtaagtaatctgttgatattacagagagctgcaggtggtgggattgcagtatggatcattttactgaatggactttcgagggtgacctgaacaacatacatgaagcatacagagccatgtatcagcagtaggagtcaccgggaaccgaacccgttatcaatcaggcgtgtatgatagtacatgagagagtggaccggatggtcaagatgagtggtaccgcgataataagattttattaccgtctcaagcaacagcttgagacggttttttatgtaataggaaacttcgtttccattacataaaaaacactccgtgaggatcgcactgcggcggataagaaacatgtcgcatattgcgacccgccgcaggcggagaatctcgcaggcgagattctttttatacttgcaaacaaaaccgcaatacatgattcttataactttcaaaacggatttctttcaaaaacattcttaaaatttggaggaaaaaatgatgaagagaaaaatgatggcagcagtattgacaatggcaatggcagcaacaatgatcggtggatgcggaaacagcacagacacatccaatgcaggaaacagcacgaacacaacagagaacagtgcagacgcaaccgacactgcacagaatactgcagacaaaaccgtgtacaaagttgggatcgtacagtatgtagatgatgcatccttaaaccagatcgagaaagcaattgaagcagagctggatgcaaaaggagcagaacttggtgtgacatttgattatgcagattacacctataatggtcaggcagattcctctaccttaaatcagatcgcagcagatcttgtggcagagggcgtcgatgtgatcattccgatcgcaacgccggcagcaatgatcatgcagaacgcaacggaagataatcagatcccggttgtattttccgcagtatcagatccggtcggagcaggacttgtagcaagtgcagatgctccgggtgccaatattacaggaacatccgatgcaattgatgtggcacagatcatggatttcattttggcagcggatccggatgcagcaaaaatcggattgctgtatgataagagccaggattcttccgcaagtgctattcaggcggcaaaagattactgcgatgaacatgggatttcctatgtagaaaaaacaggtacaacaaccggtgagatccaggcagcagcagattccctggtagcagaaaaagtagacgctatttttacaccacaggacaacactgttatgacagcagaacttgcgatttttgaaaaatttgcagacgcaggtatccctcactacacaagtgcagattcctttgctttaaacggagcattcttaggatacggcgtcaactatgagacacttggaacaaagacagcagacatggttgcagacattcttgcaaacggagcagatccggccacaacaccggtagaaacattagacagcggtatcgtaaccgtaaatacagagattgcagaaaaagtcggaatcgattattctatctttaaagatatgtgttccgaattgatcgagacagtaacagcagaggagtttaattaaggtatgggttccattattacattatcaattgtacagagtgcattagaacttggttttatctatgcactggtcgcactggcattatttatatccttcagtattttaaacattgcggatctttcgaccgatggatgttttacattgggatgtgccgtctgtgcatcggtgacacttgcaggtcatccgatattaggattatttgcagcgatggcagctggtgtctgctccggttttgtgaccgctttcttacagacaaaaatggggattcagtccattttggcgggaatcatcgtaaataccggattgtatacaattaatattgcagtaatgggattcgcttccaacatgaacttattcaactgtgaatccgtttttacctgggcaaaaacagcaatcggtggaacgtggtataaactgatcgtggctgcactgatcgttatcattgtaggagtgctgatctctttctttttaaatacaaggcttggactttccatccgcgcaaccggagataatccggatatggtaagagcttccagcattaatacaagtgccatgatcacgatcggactttgtgttgccaatgccctgaccggtctctccggcggactgcttgcgcagtatcagaaatcctgtgatatcaatcttggaaccggaatggtaacaatcgcactcgccagcctgatcattggggaatctatcattggaaaaggcggtatgttacagcgtgtgaccggcgttattttaggaagctgcctgtatcgttttatcgtggcagttgccctgagattaaatgtaccggcagagtgtttaaaacttgtttctgcaatcattgtagccgtggcgatcgcattcccatatctgaaaaagcagatgaatttttaccggcagaaacgtgccgcaaaggctcagaaccagatatacgttcaggagattacgaaaaatgacagcgaaggaggagaaagataatggcagagaagaacgcaatgcttgtgatgcgcgatgtcagcaaaacttttaatccgggaactgtcaatgaaaaatgtgcattaaaaaatctgaatctcaccttaaagcagggggattttgcaacgatcgtaggaagcaacggagccggaaaatcaacgctgtttaatgcgataacaggagccttttttgcagacaaaggactgatcatgctggatggtgaggacattacctatcagaaagagcatgtccgcagtaaagtgattggtcatttgtttcaggatccattgaagggaactgcaccacatatgacgatcgaggagaatatggcgcttgcctacctgcgcacgactacttcaaagaatgcctatttcagccggatcaaggctgcggacaagaaaaaattcagagagcagctcgcactgcttgacatggggttagaagaccgtatgaagcagccggtcggacttttgtccggtggacagcgtcaggcactcacacttttgatggcaacgatggtgactcctaagattttgctgctggatgagcataccgcagctttagaccctgccaccgcagagaaagtactgaacctcacaaaaaagatagtgtcagagcagaacatcacctgccttatggtcacgcacaacatgcatcaggcgcttgaacttggaaaccgtaccctcatgatggattcgggaaatattgtgctggatgtttccggggaagaacgggaaaagatgtcagtggatgatctgttagagcagtttgcagtccgtgccggaaaggcattggataatgacagaattctgttttccaaagtggaggcataatagtggtgtagtaagaatagaagctataaataattggtatgtttcaattatatgaaaaagcaataaaacaagggaaaagccgttgaaatctaacggcttttcctttattatataaagtaatgctaaaaaaatgtatattttcataggagattcgtgattaagaaaaacgattacagagatgaaaaaggcagtgagtatatacaaggaggaataacatgtatccaatcgttagaagagaaaaactggcagacaagatctatcttatggatgtcaaggctcctcgtgttgcgcagtattgcgaaccgggacagtttgttattgtaaaaattgatgaggagggtgaacgtattccacttaccatctgtgattacaatagagaagagggaacaatcacaatcgtattccagaccgtaggagcttccacagagcgtatggtaagcttacaggaaggggatgcttttgaagattttgttggacctttgggatgtccatctgatctgattcatgaagatattgaagaattaaagaaaaagaaaattttatttgttgcaggtggtgttggtacagctccggtttatcctcaggtaaaatggctgcatgagcacggcgttgactgtgatgttatcatgggttcccgtaacaaagatttacttatcttagaggatgagatgaaaaaagttgccacaaacctttatgtgacaacggatgatggctcgtacggtttcaagggaaccggtactgcacagctgcaggaactctgggataatggtaaccgttatgaccactgtgtggcaatcggaccaatgatcatgatgaaatttgtctgcaaactgacaaaagaattaggaattccaacggttgtttccatgaatccgatcatggtagacggaaccggaatgtgtggtgcctgccgtctggttgtaggcgatgaggtaaaatttgcatgtgtagacggaccggagttcgacggacatctggttgattttgaccaggcaatgagaagacaggctcagtataagaccgaagagggaagagccatgctgaaattacaggaaggtgcaacacatcacggtggatgcggcaattgtaacagttaaaaatcagaaattttgcagatcagagagaaaactgtctggtcagttacatagaatcaggaggaaaaaatggacgtattaactagagttccggttcgtgagcaggagccagccgttcgtgcagcgaactttgaagaagtatgtttgggatataacgaagaagaggcaatggcagaagctgcccgctgcttaaactgtaaaaatgcacagtgcatgaaaggatgtccggtatctatcaatattccgggatttatcgcagaagtcaaagaaggtaattttgaggctgcttaccatgtgatcagcgagtcttccgcacttccggcagtctgtggccgtgtatgtccacaggagacacagtgcgagggaaaatgtatccgtggaatcaaaggagagcctgtagcgatcggtaaattagagcgttttgttgcagactgggcaagagaacatggcattaaaccgaaaaaggcagaaaagttaaatggacataaagtagcagtgatcggctcaggtccggcaggtcttacctgtgcaggagatcttgcaaagcttggttatgatgtgacgattttcgaggcattacatcaggcaggtggtgtgttagtttatggtatccctgaattccgtcttccaaagcagaaggttgttgccgctgaagtggaaaacgtgaaagcattaggggttaagattgagaccaacgttgtcatcggtaaatccgttacaattgatgagttgatggacaacgagggctttgaggcagttttcattggttccggtgcaggacttccaagatttatgggtattcctggtgagcaggcaatgggtgtattctcagccaatgagttcttaacaagaaataaccttatgaaagcgttcttagacaattacgatacaccgatcaaagctggtaagaaagttattgtagtcggcggtggtaacgtggcaatggacgctgcaagaacagcaagaagacttggcgcagaggtatatatcgtatatcgtcgtggtgaggaagaacttccggcacgtaaagaggaagtacaccacgcaaaagaggagggtatcatctttgatcttctccagaatccaaccgaattattagtggatgaaaacggttgtgtaaagggtgcaaaagtgatcaaaatggaacttggcgaaccggatgcttccggaagaagaagtccggttgagattccgggctctgaatatgagatcgaggcagatactgtgatcatgtcacttggtacttctccaaaccctctgatctcatccactacaaaaggtcttgatatcaaccgcagaaaatgcattattgcggaagaagagaccggtgcaacttccaaagaaggtgtttatgccggtggtgacgctgtgacaggtgcagcaactgttatccttgcgatgggtgccggtaaagcagcagctaagggtattcacgaatatctcagcaacaaataaaaacagacaggacagggcaggtgctgaatgggtcatacatttggcacctgtttttttctgtaagtattccaaagaaaccccaaagttttattaattttttatgaagagggtagccaaattacagggtttatgtatataatagaacacgctacgcaggaaagaaatacgagagaggttaccgatagatgaaggagcagaatcagcgccagatacagaatcagacagaattagacgaaagaagactgagacagaaaaagcttgtacggaaaagaaaaatcgttttgagtgtaatgcttttgacatcttttttactgggatgtgtctgtggaagatattttcctgagatcaaacttggaaaaacagaagaagtgctggcatcagcgcaggataactccgatgaagagaaaaaagaaaatcaaattacaaatgacgtagataatggaacaacagcagatggaacggaaaaagtggaacagtctgctacggaaactgtcgaagaaccggcagacagcgaagaaacggcagacagcgaagaaacgaatgatccgttcgcggagattccacaggttgtgttatcaaaaccggtagattattccttgaatcaggcaatcagacagttagaacagatggaagcgtcagatgaacgctacgcacagatcgtggaaaatgcagagaaatatccggaaaaattactgatcaatctggcaaataatccggaaatgatcgcatttgtagctgattataaagggaacacaagggattatgataaagcagaactgacagagaaagagttacaggaagaatatccgctctttttacagtgggataaacgctggggctgccttgcatatggggatgacagcaatgttgcgatcagcggatgcggtccgacaacactggcgatggcagtagttgcgctgactggaaacgaggaggcaactccggctgcaatcgcaaaatttgccatgcaggaagggttttatatgtccggcacaggaacgatgtggtcgcttatgacagagggggcggcagcttacggtgtccgctccgagcagatcaatatcagccagactgagatcaagcagcacttagatcagggagacatcgtgatctgctccgtgcggcagggagatttcactacagggggacattttatcctgctctatgattatgatgatgaaggattttccattaacgatccgttttctttataccgcagtggtcagaaatgggactatggaaaaatcagaagccagatcaaagctgtctgggcattaaaagcaaaataaagaacagttagcgattgttcaaatagtttaacaaaaaacagggcatactaaagcatcataaagtgagatggagagatgcagaatgtgccagaatatgagtggactgtccactgctgaagtggaatttcggaaaaaagcagggttgtcgaatgaaagcgtagattcttccacaaagacagtggcacagatcatccgctcaaatgttgtaacttattataatcttatttttttgatcattacgatccttctgatcgtggtgggatcttttcgggatcttacttttttacctattattattgcaaatatgttgatcgggatcatccaggagctgcgttccaaaaaaatcctggatgatcttacgatattaaacacaccgaaaatcacagtccggcgcaacggaagtgatcaggaggttttggcggatgaactggtgcaggatgatgtgataacgctttcagcgggtggacagatcccggcggacgcgctggtgttatccggcaatatcacggtcaatgaggctttgatcacaggggaggccgatgagattataaaaaaagagggagatccgcttttctcggggagttttgtgatatcgggagagtgcctggcaaaactcgaaaaagtgggaaaagattcttatatttcaggactgatgttacaggcaacgcagacaaaagagggcgagcagtcggagatgatccgggcgttgaaccgccttgtgcagaccgtgggcgtgatcattttgccgatcggggcaatcctgtttttacagcaatactttttttccggggcaacgatgaaagatagtgtgacgggcatggtggcggctattctcggaatgatcccggaaggcctgtaccttcttgcaagtgtggcgatggtggtgtcggtgatgaggcttggaaaacaaaaggtactgatccatgacatgaaatgtatcgagacactggcgcgggtaaatgtgctgtgcgtggataagaccggaaccattaccgtgccggaaatggaagtggcacagtttatccttgcaaaagaccagaaccttgcagcgaaagaacaggaagcagaccagcaatcggaagacaaaaataaaattgcaaagctgctctctgactgtgtgcgtgccctgccgtgcgacaatgcaacgatggaggcattgcagcagtattttacggagccgatggaaaacagtgcagaaaaaatcgtcccgttttcgtctgccacaaaatacagcggagtggttctggcaggaaaagcttatgtggtcggcgcaccggaatttgtgctgcggcaggattatgcggctgttcagggaacgatcgaagtatttctggaaaagggatatcgtgtgcttgtatttgcagagtatgaggggaatctggatggaaaagaactgacagaaaatgcaactcccattgcatttatcctgctcaacaatgcaattcgtgagggggcaatggatacattctgttacttttccaagcggggagtggaagtgaaagtgatctccggggacaatccggtcacggtatcggagattgcaaagaaagcgggaatccgccatgcggaaaaacaggtggacgcagcaacgttgaaaacagcggaggcagtgcggaaggcagcaaaaaaatacacggtgttcggcagggtgacaccggagcagaaacgtcttctggtgcaggcattaaaagagcagggaaagaccgtggcaatgaccggagacggcgtgaacgatattcttgcgttaaaagatgcagactgcagcattgcgatggcatcaggcagtgaggcggcttcgcatgtggcacagcttgtgctgctcgataacgatttcaataaaatgccggcggttgtcatggaagggcggcgggtggtgaacaacatcgggcgcactgccagcctttatctggtcaagaacattttctccatgctcttagccgtattttccatgctgtttctgatcgattatccgctggagccatcgcaggtgtcgctcatcagtgtctttacgatcgggattccgtcattttttctggcgctggagcagaaccggaatcagatccatgggcattttcttaccaatgtcctgatccaggcgcttccggccgggattacagattttatcgtggtgagcggtctggtgattttctgcagggagttcggggtggaaaaagagtgcgtttccacatcgtgcacgatcctgatcgcagttgtcggcttcatgatcctttatcatatagcaaaaccgatgacaacaccgcatgcgatcctgatcgcagcgatggtcatcggctggttattttgtatgctgtttttcagtgaactgtttgcgatcacggcggtcacaggaaaatgtgcaatgctcatgatcgtgttcgcagtcatcacggagccggtgttccggtatctgatacagcttgtggaggctgttcagaagtggggcggaaaactaaaattttagtctggtgaaccggcatgttttttccggctctgtttttcccagataaaatacgtcacgatcagaaggattccggtgatcagccatgtgatcgggcttgccagacggactgcccagtaaccgaacggatttaaggtgacggcgatcacgataatacggcacaccatttccacaacaccgcttaacattggaacaagtccgcggtttaagccctgcagggcgttccggtaaaggaaaatccatgcgagcggcagcatgaagaaactgatggtgttcagatactgcatggcatagtcgaaaatttcttcagaaggattgctcacaaaccagctcacaataaaacgtccgccgaatacgcagatggcagaggcagcaagcgagataaaaatgcagatgaaaaatcctttgcgcattccctcgtagatacgtttgtattttcctgcgccgaggttctgaccgcagtaggtggcaatcgcagtgccgagtgtcggcatggtctgggtggagaggttttccactttggaggcggcagtgaaggcagccacaacactggaaccgaaaatattgactgcaccctgcaggatcatggttccgatagcggtgatggaatagttgagcgccatcggaataccgatggaaagcatattgaacacaccgtatccgtcgagatagtaatcttcccggctggtttttaaaatgtcgaatttgcggaacatataaataaagcaaagcagtgcggagacaccctgcgcaatgatcgttgcataggcagcgcctgcggttccaagttttacgacgacgatcaaaaacaggtcgagcacaatatttaaaaaggaagagagaatcaggaaatacagcggtgttttgctgtcgccgatccctcttaaaataccggcggcaacgttgtaggacatcgtgagcaggatacctgcgaaaatgactttaatataagagtctgcgagtcctaagatattgtccggtgttttcattaaaataagaaactgtctggaagctgccactgtagggatagtcagaagtaacgatacaatggcagtcagtatcagggagagtgcgacataatgctttaacagcttgaaatcttttgcaccgaaggcgtgggagaccataacgccaaatccctgcgcaataccatttgcaaatcctaatacaaggaacatcagacatccggtagagcctaccgcagccagagcatcctcaccaagatactgcccgacaatgatcgtatccaccatgttataaaactgctgaaaaatatttcccagtaaaaccggaacggaaaaaagtaagatcattctgagcgggcttcccattgtcatgtcttttgtcataatctgtactccttgatttataaaatagttaaaaatctgtccgtgttttttagcctcaacacgcatattctttacgtttcagcaacttagtataaggcatggaccgcaaaaagacaatgtttatttttgcgaaaaaatataaattttttgttttcgcaaaagaaaagattttttcgtgggaaactgttataataagaaagcaattatttgcaagtcacagtaaaatcacggagtaaaataatgcagacaaacctcgaatactacaaaattttttattatgtatccaaatacaacagtatctccctcgcagcagaggcactttccatctcacagccggcagtcagccaggcagtcaagcatttagaaagtgatctttcctgtgctctctttgtgcggacatccaaaggcgtgcgcttgacaaaagaaggcggactgcttgcagaatatgtgagaaaaggatatgagacaatccttaccggggagaaaaaactctcagagatgttaaacttagatgccggagaaatctgtgtgggggctagtgacatgacattgcagttttatctgcttccttatttagaagcgttccatgatgcatttccacagatcaaggtgaccgtgacgaatgccccgacaccggagacgttgaaacatttacaggacggaaaaattgattttggaatcatcagtaccccggtgaacaacaaatacgattttaaaatgacacctgtccgcaaaattcaggatgtctttgtggcaggaaaaaagtttgagtacttaaagggtggaaaattaagctataaagagcttgaaaatcttccggtgatgtgtctcgagggcagtacttccacaagaaaatatgtggaagattatctggcagagcgcggcacatttgtccggccggaatttgaacttgcaacaagcgatatgctcatccagtttgcagtgcgcaacctcggtgttgccagtgtcgtgtcggatttcgcagaaaaatacattgaaaatggggaattattcgtattgaaatttgacagggcgataccggaacgtgagttttgcattgtctcaaacgagcgtgcgccgatgtcggcagcggcagaaaaattatatgattttctgcttgttccgtagtgaaaaaatgtcagaaaaagttcatcaattcttcatcaatcttaatagaatatcaatgggattgcgggcaggaatatgataaatttatatgcaggatcaggatatttagggggaaacgtaaatgatgcgtttattatcgatcgggatagactgtgtctcgtctgctatttttgtgattcctgctttggctattttgcagtgtacaatctacaggaaatgggaatttaaaccattttgtgtaaaactgatatttgcattttatgcgattgctctgttttcggttgtgggtgtccctgcggttgggatatttcagatggattttggtctgaatctgataccgtttgcagacattgtaaatagtccgtttgcatatatgaaaaatacgattttgaatatcattttatttataccgatgggattttttgtacctgcggtctggaagaatttccggtctttcaaaactatgtttttcatgggactcgcggtatcactggggattgaactattacagatatttacattccggcttacggatattgatgatctgattaccaatacggcaggaactgtgctgggatatgaaataagcagaagattttcttttccgttctctttaaaatcagtggattcgaaaggaattttggtacgatatgaacctgtcctgattctggcagttacgctttgggtttccatgtttctgaaaccaatggtgtctgatggcatatggaatattataatataataaacaattatatcaaatataatgaatattaattttacttatgacatatattcgtgtataatcataaagtaaaaacaggaaagcgtgatggtttttacagaccatcactttttttatgcaggaggaaaatcaaatggttacagcagtagtaggcgctaactggggcgacgagggaaaaggaaaaatcacagatatgcttgcagatgaagcggacatcgttatccgttttcagggtggagcaaatgcaggtcacaccatcgtaaacaactatggtaaatttgcattacatacattgccatccggtgtattccacagccacatcaccaacattatcggaaacggtgttgcactggatatcccgaaggtaataagtgagatcaaatcgattacagaccgcaatgtgcctgcaccaaaaatcatgatttcagatagagcacagatcgttatgccataccacgttcttttcgatcagtatgaggaggagcgtcttggaaagaattctttcggttctaccaagtccggtatcgcaccattttattcagacaaatatgcaaagatcggtttccaggtaagtgagttattcgacgaggaattattacaggcaaaagtaaaacgtacctgcgagacaaagaacattatgcttgagcatatgtatcacaaaccattattaaaagaagaagagttattagctactttgcatgagtacagagacatggtcgctccatatgtcggagatgtttctttattcttagacaaagcgattaaggaaggcaaaaagatcttattggaaggccagcttggtactttaaaagatccggatcacggaatttatccaatggtaacatcttcctctactttagcagcatacggtgcgatcggagcaggcatcccaccatatgagatcaagaagattgtaacagtaagtaaagcatactcttccgcagtaggagcaggagcattcgttagcgagatctttggagatgaggcagacgaactgagaagacgcggcggagacggcggtgaattcggagcaacaaccggacgtccaagaagaatgggatggtatgactgtgttgcaagtaagtatggatgccgtctgcagggaacaacggatgtagcgcttaccgtacttgacgtattaggatacttagatgagatcccggtatgtgttggatacgatatcgacggagaagtaaccacagacttccctgtaactgcaagattagagaaagcaaaaccagtattcaaaaaacttccgggatggaaatgtgatatccgtggaattaagaaatacgaggatcttccggaaaactgcagaaattacattgagttcattgaaggacagatcggatacccgatcacaatggtttctaacggaccgggaagagaagatatcatttaccgcaataaataaagagactgaggcaggcgtgcagtggcaccctgccttttgtgacaaaacatggaggattgtatggtaaagaatataattttagatgtcgggaaagttcttgtggcgtgggagccggaagacgcaatgaaacaacttggatttgatgataagacagtgaaagcagttgcggatgctacggtcaatactccggtctggcttgagacagaccgtggcgtctggtcagatgaacagatcctacaggcattttatgagaaggcaccggaatataaaaaagagatcgatctgttctggaatcatctggaactggcaatcacacagttttcctatacgaaagaatggatttccaatatgaaaaaagaaggcttgcatgtgtatattctttctaactatggagattggacttatcagagaacgaaggacaatgcgctggatttcttactgttgacagacggcgatatcttttcttacagtgtgagacaggtcaaaccggatgtggaaatctatgagacattattaaaaaaatatcagctcacagcggatgagtgtgtatttatcgatgaccggatggaaaatatcgagggagcaaaaaaagccggaatccacggaatctgctttgagacgatcgggcaggtgaaagaggatctgaagaaatacaatatatatgtctaaataacaggtacttaagaagagaaaaaatcgtcgtttcacaaagttatcacaatttttaccaaaattaaacacattttttcaataagataatactatcgaaaaccgacagttgcgaaattcgtgaaaacagacggatttcgcgattttcatgcgagccggaagtaaggaggaaaagattgtgatcgagatcagccatctggtaaaaaaatatggcgaccatattgcagtgaatgatctgacattgactgtggaaccaggaaaaatttatggatttttaggaccaaacggcgccggaaaatccaccacgatgaacattattacagggtatttaggtgcaaccagcggagaggtaaaaatcaacggatttgatatttttgcacagccggaagaagcaaaaaaatgtgtgggatatctgccggagatcccgcctctttatgtggatatgacagtcagggagtatctgaactttgtggcagagttaaagaagctcgaaaaaagtctgagaaataaatatgtggaggaggcgatggagacgaccggaatcaccgcacagcagtcaagactgatccgtaacctgtcaaaaggctacaggcagagagtcggatttgcacaggcagtgctggggtatccggagatcatcattctggacgaaccgacggtcggacttgatccaaaacagatcatagagatccgtgacctcatcaaagaacttggcaaaaatcatacggttattttaagttcgcacattttgtctgaaatatctgcagtgtgtgatcacattttcattatttccaaaggaaaattagtggcaggcgattccacggagaatctgatgaaacagatgtccggggcgcaggagatcgaacttctgatcaaaggagacaatgcggcagtgcaggagacattcaccgggatcgcagaagttgaaaaatgcattccattagagcagaaggacgaagcgtgtgtacatctgaatctgatcgcaaaaccgggaatggatatcagggaacaggtgtttgcctcctgtgtcaaccatggatttgtcattctgcagatgaatcccgtttcaaaatctcttgaggatgtgttcctcgaacttacggaaaaagaggggacacagaaggaagttctgccggagaaaaaactccattttgtaaagtctcattttggaaaagagagtaaggaggacggggaataatgtttgcgatattaaaaagagaagtaaaagcttactttcagacggtgacaggatggttgtttattgcagcagttcttgtactctatggactatatttttatgtttacaatctgcgcgcaggctatccttatatttcttactcactgtcggcaatcgcatttatcatgctgatcacggtacctgtgctgactatgcgcagttttgcggaggaacgccacagcagaacagaccagttgatcctgactgcaccggtatctgtgggaaaagtagtattgggaaaatatctcgcaatggcttccgtatttaccatagatatggtgatcattgcgatcacaccattgctgttaatgtcctacggaacgatcccattaggtgaatcctatgcagcagtgcttggattctggctgtatggctgcgcctgcattgccgttggcatgtttatttcctcattgaccgaaagccaggtgatttccgcagttttgacatttgttgcattatttgccggctatatgatgggaagcatctgcaatctgatctcagagagcgggaatcttctgacaaaaattttaggctgctacgatctttacacgccgctcgataactttatgaatggaacactggatgtagcgggaattgtctattacgtaacgatcattgcattacttttgttcctgacagggcagtccattcagaaacgccgctggagcatcagttcaaaaaaaatatcgacaggtgtattttcaacgggaatgatcattgcaatggtggcagtgaccgttgttgtgaacctgttcgtggcagaacttccggcaacatggacatccattgatgtcacttcaacaaaaatttactccatcacagacgatacgaaggattatctgaaaggtctcgacgaggacgtgacaatttatgtgctggtgtccgatgcatcaaaagatacaaagctggatgagacattacagagatatgaatccctgtcggatcacatcaaagtttcctatatcaatccggctgcaaacccgacttttgcagcacagtatacagacagttctgtgacttccaacagcatgatcgttgtgagcagcgcaagatccagagtcattgattacaatgatgtgtatacctatagttatgattacagcagttattccagaagcattgatggatatgatgcagagggacagcttacaagtgcgattcagtatgtgaccatggattcgacagaacttccggtgatctatcaggtgtccggacatggggaaacagctttgtccggtggctttacagaggcaattgaaaaagcaaatatcacattatctgaccttgcattattaaaagaggatgcggttccggaagatgcagcagcgttgatcattaatggaccgaccactgatttttcggaggatgatgccagcaaagtgatcgattatatcaatcggggtggaaaagtgctgatcacctgtaattttcaggcgcagggtctggaaaacttcgagtcaatcctgtcggcatgcggcatggaacgggtttccggtattgtgatggaaaatgataaatcctattactatagcaatacaccgtattatctgcttcctgacgtaaattcaagtgcatatacaagttccgtcagcggttcatatatctttgctccatacagtgaggcaattacctatggagaagatacagatgatacaacttatacagtattattggagacgacagataaagcagtatccaagacagatgcagcaaatgcaacaacatcagagctggaagagggagatgctgcaggaccatttgcggttgcggttgccatggaaaaaacaatcgatgaagatacagtcgcaaaagtagtggtcgccggatctgtggaaatgtttgcagacagtgcagaccagatcgtttccggaaataacagcgcaatgtttacagatatcattgcccagatggttggcgattctgatcttgcaacaagtgtgatcccaacaaaagattacacgctcagcgccatcacggtggatgcagcggcagggatcctgtacgggcttggtctgatgatcgtgcttccggtcattatgatgattcttggaattgtgatatgggcatcaagaagaaaaaaataaaacaatagataatagaaaatcaagattggagacagatagaatatgaaaaaacagaaaattcagtttattgtaattctgatcgtgctggcagtgcttatcgctgccaccttcggaatgaaatggtataacaaaaataaagaggaagagaaaacagcggaagaagaggcttctaccatttatatttccaaagtggacgttgacacgatcacagcattttcttatgaggttgaccatgtgacgtatacttttacaaaggatggggatacatggacctatgacggagacacatcactggatatggatgaagaagcgatcgacagcatgcttgcaacactgtcatcgctgacagcaatagaagagatcagtgattatacagatctgaaagagtttggatttgaccagccggaagatctgatatcctacacaacaagtgaagggtctgtttctctttttgtaggaaataaaaatgatactttgaatgcatactatattatttcagctgatggaggaagcatttatctgacagaaacgtctcttgcggatgctttttcaaaaacgattgaggagctgacagtcacagaggatacagaaagcacggagacagttgagaacacagaagaataaataagataaaagcagaatcagcacctgacagaaaattttgttcaggtgctgattttttaatgctctgcagtatctttttcttcggaatcttttttgatcagtttgtaaataaaactgtatgcccagattaaaacagggatgatcacagaagcataaatagaggtcatgagcatgttcataaaattttcgctggcagaaactgcacagacgatagtagaaatataaagtccagccagaatgatcacgccgatgattgctaaaatttgttttatttttttcatattttgaatcctttcgggaaaattgtaataaactatggtacaatcatcgtataggaaaaaaacagtttcgtcaataaaattgtggaagaaaaggcaggtaaatcgggtggcatatgaaaagcttttgaatgaaatttatgcggcagtatcattgaaatatctgtggaaggaatatgagccgtattttgtgaaaagtgaatcaccggactggattaatccaaacatggatttcgggctggaagtcagtcaggcacttttgccggatgacgggcaggaggagagttttatcgaaaaatatcttggttgccggaaagaggaactaccttctttggcgtttgataaatatggagagcggttgaatttttacaatggaaggttttgggcgattctgccagataatactgtgcagcaagattatctttccaaggcgaaatatcgttttgaccgcaaactggaaaaactaaatgcaaattatatccataagcactacaatggtctgtatctttttctacatccgaccgacgagaatgatattgatgcaggtgcactgtttgaatatatgagatatacacaggaaaagaaaaaaatgcgatttgaccgggtatttttaaattgtgtcaaaaccatttatgtctgcaattacgaaaacaatacaattgagccgattgtgctgccgccaaatgcggaaaactttttgaacacggaggcggagtacttacgcaattgctgtgactggaaggatgggacagcgctggagatgaagcgtggcgatgagaatagggtatatcatgtgcaataactatgagcacactggtttcttattaagttaaaaatctttaatgcagattccatgtctctactactaattctcaaatgagaagatggcttatactgtttgttgtatttttcagaataatactttgcaattgtgttcttttcggaatcttttaaggctgagtacagatatgataaattaccgattgtaagataatttcccttcatgcattccgtctcaaaggtagttaggaaagtagtaaaatcgctatttactacctatgcaatcaaccgtttaaaaaacagaccaaagaatatggtattattaaacacaacattgacagtattttgcggcaggataaggagcaggaacgggaaaaggaaaaggagcgcggataaacaaagtcaattaatttcttgactttcccaaaatcaccccttacaataaacctatcttttttatcaaatcaaagttacaaaacatactaacataacaaaaaaatccatcaccacatcggtggatcattcagcaggagaaaatgacagacacaaatttagaacagtaactaaaaaatccatgcaaacagtcttgaagaatcttgaggggttctatataataaacatagatcattcggaaaacctgtttgtataccataaaagcaggaggtcaaatgaccaggaaaaaacaaaagaccaggaaaacacaaaagaacaggaaaaaacaacagacattagaagaaaagatagaacaggttaaaaatttcagacctattgatgatacgttttttgaagtactggcagatgatattggcgtatgtcaggagatgctgcgtatcattttagaagatgagaaactcatcgtaaaagacgttatcgtacagagcagtgagagaaacctgtatgggcgatctgtccgactggatgcactctgtatccttggaaatggaaaaaagtgtaacgtggaagtgcagcgttctaacgaggatcaccatttaaaaagagtgcggttcaatgcatcggtcatcacggtgcgggactcgcagacggatgataaatttgaggagacgatcgatctgatcgttgtgtatatttccgagttcgatatctttaaatgtggcagggtgatctatcacgtggacagcgtgatccgggaaacacaggaaaaagtagacgacggattggagcgtgtattcgtcaataccgcagtaaaagacggaacaactatctcagaatacatggactgttttctgcaaaaagagatagataatgccaaatttccaaaattaaccaaccgtgtgcattatctgaaacatgaagagggaggtgtaaacgcagtgtgtgaaataatgagaaaatattcagaagaagtcgcagaaaaagcatatcagcagggcgaggaagctggcaaaaaaattggcaaagaaatcggcaaagaaatcggtcaacgccaggcaaacattgccgccatcaaaaacatgatcatccgttttcaggcaacgaaggaagtcattctggaagattacaccgagtccgaatacaacaccgccatcgccgaactccagtctgaatccagatagcccaagatcaaaacaaaccaaccccaaaacccacccatcacagagccagcccgtcaggagctggctctttccacatcataaaacccataccacatcataaaacccattccaccaccacttggaacatattaattgctataataaaaacgcaagaataaattgcatttataaataataaacataattataatgtatataaaattaataaaaagcaaaaaagcattgcattatcataaaataaacgatactatataagtgagataataaagaaaggctgcgtcgatatgaagattcaagctgtattcatagatggatttaagaacttagcaaatgtaagaataacttttgataatattacaacacttgttgcattaaatgattttggaaaatcaaatgtactttcaggtattgattttggattgagttttataaaagcatcgatagaagataaaaaggatatgatgtccaattcccaactgattcccggtaattgtaatttgattggaagaaattataaatatgagatggaagcagcagcagatattaatggcagggaatacttggtgcagtatggctatgaatttgaatggaaagataccgatggcaaagagccagaaataatttcagaatttttgaaagtaaaacttaatgaaaaaggacaaaagtatgcccagctaatcaatagaactgctcatacagcattctataagagttcggagacgggaagatgttcatcaataattaaggttggggagacagaattagttgtgaacaagttaagagcctatgatgaattatattatgccctgattattacaaagcttaatggaataaaaataaatatgggaaacaatctggaggctaagagcttctgccagtcagattctgttattcggaaaggtttcgacaatgcgtcgataaatgaggataatctgccacaagttatatataggctgaaaagccagtatccagataaatttgcattattaaaagaggcttattttcagttatttcctgaatttgaggagattattgtaaaagattttcagttaaatgtagaagaagatcaccagcttcgggagaatgcaccgtttcaatttacgattgctgtctatgcattatttgttaagagaaaggggctggtgaatccggtaaacttttctacgatatcagatggtgcaaggcgggtttttatgatattgaccaaaattattgtagccagtgtcagtaatatttcattgatagcgatcgaggagccggacaactctgtatattctggcttgttcggggcgtatatcaggatgattcgtgagctgtcagctggctgtaaagttatcattacaagtcattcaccgtactttgtcagctgtcttgatccttctggaatttatgtcgggataaatagaaaggctggagtagcggagttttttccgtttaagaagtcagggcagaaacagctggtaaatgatgcagttagtttagatttgcgaatgggggagtatctgttttcaatgcttgcagattctgaaagtaatataagggattatttggattgggacaatgaataaatgctatatcaaaggagaaaatcaacatggtggataatgattacacattggaaggcaggtttgaaattgccaatgagaacatgaaacaggagatgaatgagcttatcatacagatactgtataagacaggaatcagaaagaccacgactgtaatgatcaatggtcgggagttcgatgcagttgaacagacatatccggatgaaaatggaatcatttatttcgattattctgtatttgaaaaaaggataagaagaggaaactattataattgtcatacttgtgaattggtaacggaagatcgcggagaaaatgaatttggtctggtcatgaacatgataatgataatattagagtcctattcggacagtccgtgttacctgatgcataaaggtaatctatttaacatcctggggtacgttgatctggtagaaagcttaacaggaaaggttttaacctttaaaaacagagacaatattggaaaaataaaaggaataccggtagacaggcatttgctttataaatgcattcttcgtgatgatgaagatgaacttctgggatttttggattctgaaaccatattgctttcagaccaaagaaaagaggaaatatccgaatggagtgacaggtataaaagtttgaaagatgatgatgtgaagtcttttgatatggaagctgcgctggcgaaagcgatagcaatcatgtctttggagtgggaatgcagatatgtgaataaggatatggtagatgagttcatcggaaataaagaagtatcatcttataaaaaagcggtttatctgttacagaaactacttgaggaagatatggagatgtttggagaatttacgaaaacacaggtgttggaatggattttgtatgagatagatccggaggaaaaagaaagcagctattccgcgtatatgagtctgcttggaaataagaagtacagaaaagaatttatgggattttaatggaggataatatggggactttttgtgattataatggaaacatgacaattccggacgaattcaaagacgaatttaatgagaatatgataaaaattcttcagaggggcggaatgatgcagtttgaaaatgtacacatgtatgggaaggaaattcatctgatccgtccggttgagtgcgatgaggaagggaaagcatacttttcttttaattactttgaggatgacttatgggaaagtgtgttattcaattccaggacgcaagtcctgagaagtggcaaaataggaaacaacgaatttaacagagtcatgtgtgcagcttatctcttatatgaattatatggaatggattatgggtatgttgacaggaatggggattttatagatccggtacgctgcatagcatggatcaatcatgttcttgacaaagattttactgccgaaaaacgatttaatctctggaaatattatgagagttattactttacggaaatagaacaggatcattatgacagggcatatccgaaaacggtgtttggtattattccggaagaattaagaggtggaatgggaggcagagatctggcagatatctattatattgtatatggaacaggggatatggggatgaatgaagccagcagcggatcatatccgtatgagataatgtgtgtaaaaaaagaattacagaaattctctgaaacatacgggtttgacagaaaaaagcgtttatatgaattattgaagcttccgtatgatgagagacaggggattgcctgtcaaaaatatggcggactggcggaaatgacactgagaataccagccagagtatttgtgtacctttttgcagagatacaaggctttgatttctggacagaatggcatgaagtgcatggagagttttatgtggatgaaattactaaaaactatgttggtgagtcggtcgtaaaaaagagagaagaaataagaaacacacagattggaaagttgaaaacaaaagattttttgaaaaataatggctgctttacattttataatacaccggcggaacttaaggataaacctgactattatctttccgatgatgatttaatgtactggtgggatggaacagataccgtacagttatcaatacggatgatcgagacattgaacaggtggtccgtagaattgaagaaatttgagacggaaataaaccgggacgaaatagaagattacgatatgttgaaaagtttgttggaattattggatagggcaaatcatgagtatagagacatatatgcatttcaaaatatgttttatgagtttgcgcaaaacaataaagatattcattattttgcggcgataaagttatttgagaaaatacttgatgaaaactgggagacaggtaaaattattcagtcagtagaatcatggagtacggcttctaaaaatgttatctgtaatgaaggcagaataaatgtcaaacgttatttgagtgtgctggcaaataagaagcttagagtgaagtgttttggattctgatgagcccctcctgccaatttctgccaattcccccatcccgattgtcctcatcacaatcacccgatatactgtaactatcccccggttttcccggagatacgtgggcagaaaatcagaacagcatgagaggaaacaacatgaggacaatcgacaaaaataccatacaatcctatcaaaatcatatttatacacaggaaaaatccaagaataccatcgacaaatacatccgcgacatccgcaccttcaccgcctggctgcagacacaggaacagaaagacatcaccaaaaaaacacatagaagctctggacagaaaaatagaaagacttcaggaaaaagtaattaaaaagcataaggaatacagtgtccttgctgaggagctttccacactgctggatgaacgacatccggaacggaaaatcgagagggtaaaacaggtgttgtatgatgcatacgtggaaagtgagcgttcattggatgaaatcattgacttgattcggaatgccgatgaatggatataggctggatttagttgtaaaatttctggaagttcacataaaaatgccaaaactaaaggtgaatatgttagctttgttttttttatttaaagatattgaaaaaatgtcacgaaaattatataataatcgtgacaaaaaaggagggcattgctatggcaaatggaatatatatcgaaataaaaaaaagaatactggatgcagaagaaggctcaatatttgtaacatcagattttaccgatattgctacaacaacaactgtaagaaaatgccttggaaggcaggttgaagagaaaaacatccgcagaattattgacggagtttatgaaaagcctgtatatagcaatttgctgagggaatatgttccggctaatcctgaaaaagttgcgtatgctattgcaagaggatttcattggaccattgcgccatgtggagacgtagcattaaataaattaggactatcaacgcaggttccggttgtctggtcctatatcagtgacggtccatatagaaagttttcttgggataatatcacgttgtcttttaagcatcgtgcaaatcgtgaaatttcatatatgtctgagacaaccactttggttgttgaggcattaaagacattggggaaggaccgtgttgatgacggtattattttgagtttgagaaatagattgcctagagaagagaagaaaaagatgttagtggaagcaactggtgtaagcgaatggatatatacagtaatcagaaaggtgtgtgctgaataatgaaagaagttgcgaaattacagataaaagacagaatggaattatttcaggcaacggcaatatccatgggaatgcagccgaatgtaatagagaaagacttttgggtatgttttatgttggaccatctattccatgattgtaagtacaaaaacgcttttgtctttaaaggtggaacaagcctttctaagtcataccatgttattgagaggttttccgaggatatagatttgattttggactggcgaaaaataatgaatgacgaggtgaatccttgggaagaaaggtcgaaaaccaaacaggatttattcaataagcagattaattcggaagcagcaaaattctataaagaggaattgatcccccagttgaatagtgaaatgaaagaaaaactgggggatggagaatggatttcggttgatacagaagatgagatggtagttaatttttattatccgcagatatttgaggcagagtatttacgttcttgtgtaagattggaaattggaccattagcagaatggatgccatctcatgagacaatcgtaactccatttgcagccgaaaaatatccggatattttttcacaaaaagatacatcggttttgaccattgatgttgagagaactttctgggaaaaactcaccatattacataaaattgcaaatttcccggagggaaagccgttgcctgccagatatgcaagacatctatatgatgtgtataatatgggcaattcatgggtaaaggaaagagcatttaaacgaaaagagttgttagaaaaagatgtggtatttaagcagaaattttattatgtcaaaggagcacattatgaaactgcaacattgagcagtattgaacttctgcccaaagaagcggtactcaatgcgttgaaagaggactatcaggcaatgaggaatatgatatatgggaatataccggagtttgaagagattcttgagttccttgaaaagttgcaggaagaagtacatgggcttgtagtaacttgatagcttgaggaacttgatacaacagtaggagaaagctgtgtttatatttgaaaaatgttcttatgtagagttgcaggcaatacaacacagagaagatttgttactaagcggttggacactgcttgaaactcaagtaaatcatacggattgagaacgccttgaaaatactgaccccagaccaaaacccacccatcacagagccagcccatcaggagctggctctttcactccagcccagccaatttcttccaattcccccatcccgattgtcctcatcaaaatcccccgttatactgtaactatcccccggttttcccggagatccgcgggcagaaaatcagaacagcataagaggaaacgacatgaagacaatcgacgaaaataccatacaatcctatcaaaatcatatttatacacaggaaaaatcccagaataccatcgacaaatacatccgcgacatccgcaccttcaccgcctggctggaagcgcaggaacagaaagacatcaccaaagactgcgtgatccgctacaaaaaacatctcgaagccaactacatgccgggcagcgccaacagcatgctcatcgccttaaacggcttcttcggatacacaggctggcacgactgctgcgtcacgatcttcaagacccagccaaaccgcatctatgcgcaggaaaaagagatgacgcgcgccgaatacgaaaaactcatcgcgaccgcaaaagagaatgataacctccgccttgccatgatcattgagatcatcggcagcaccggcatgcgcatcagtgaacttgcatcggtcacggtggaagcagtgggcaccggaaaaatcagcatatcctgcaaaggaaaacaccgtgagatctatctcgtacacaaactgaaaatgaaactgatcgactactgcaaaaagaaagacatcagaagcggagcggtcttcatcacaaaaaacggaaacccggtagaccgcagcaacatctggacggagatgaaaaaaaacgccgaaaaagcaggcgttgcactgaaaaaagcattcccgcataacctccgccatttctttgcgcgcacctactataacatgcataaaaacatcagccaccttgcggatatcctcggacacagcagcatcaataccacaaggatctacgtagcgaccacagaggaagaccatgtcaaaaaattggagcgtctggatctggtcgtctgaacgacagaaataaaaaagggcgtgtgaaaaaacgagagttttttcattcgtccttttgcttatagttataataatagctatattacataaaaaagggtatagttccccttaccccataagaatgatattatgaaatcttatgcggcagctgcaacttttttctgtttgttgtgatatttataaagattgtgtccgatagaaacgagaaatacttcaagcaatacagattttattcctcttcggacaattcttttgtaccaccggtcgtttttcatgataccaaaggtaccttctgcctgaatggatctgttcatccttagaagcgctccctggatgctttcgagattttctatcacttcctgatgcatcgctgtaagttcgcggttgatccgtacagtacggtttttatctgtctttttacattgttctgcatatggacagccggagcaatcttcacactgatacacttcttcctgacgcccatacttgttcccttttacgttttttcgatactgaagataaaagcttttcccatttggacaacgcatgattccgccttccccgattggaaaatttactgcacgaaatggatcttcatgatacttcttgtctgtagtctctttcttgaacatggtaaatttcatatatttttccattccatgctgcccacagaagatgtaattgttgtaagaaccatatccagcatctgctactgggtacttcggataaaagccatatgtagtataaaacttgttcattaatggaataaaacaatccatatctgagcgatactgatttacatcaacaacagcaatatattcatctgcaataccgacctgtacattataagctggaagcaactggtcattgcccatgtagtctgtcttgattcgcataaaagtggctgaatggtctgttttcgagtaactgttgcgatcttctccacagattttgattttttccacgtattcttccaacttagcagcatactctttgagtttctcataatgacgttgttgtgtagttttgcgatgtcccctgccatgaacaaacattgcttcattaatctgccagacttctgcatactgttcagcagcttccttcagatactctggtgcgtactcactattgatacaaagtttcatacctgtacatgaaagttcctcattgatttcctcaaagagtgtagttaccttaccaaagagacggtatctggatttttcggttgcttttttccatacccaggagtatttattcgcatttgcttcaaacttggatccatcaatgtatagatgttgaagatctacatgctctgtctcgaagatttttttgtttatatcttgaaatatttcttcaatggaatcagcaagtacttcgttgatgaagtagccgaaagtacggtaagaaggtgcttgatgatccataagatacatgaagcggagattgactttacactgatcctccagttcacgcaatgatatatagccattcgccataaatccaaacaaaactgttttcagcatgctgaccgggtcatatctgagtcttcctgtataatgttgaggaatatttttcagatatttctccagttcgatttctcccataaatctatcaaaagtcagcactggatcacagatgtccaaataatcttgaattagcattggcaaaactgcctgttttgggttagaatagattatgttattaatttttttcacaaattaattataacagaaagaaagaccttgagttcattataaactcttggtctttctttttttcgggactattcttttttcacagccccaatgcaatcagataaaagtatggtaattattaccaataacttccaagtactatttttttatcaaaaaatccgataaacgtcaatagtctgatgctaaaattcgacaaaaaatcccactttttgtaaaagaagcactaatttcatagtacttctctaggatattgttgccatttttgcacaaaaataagaccagacttctgtaaacgcctgatttttcagtgtttcacggttttacagctgaaaatcatgtttttctaattccactacatttgtagatatctgctaaaaaccagaaaatttataaatctgttcaaaatcccggtgcaaccgggcaaaggagctattcctccacacaacataatctacattatgttgtggagcttttttatgtaataaaaattaaggaggaagcctatgagaaggacgaaagcaaaccgtgcattgacatttgtgatggcagccgcactgctcattggatcgattcacggcgtaggtgcaaaagagcagagcaaagactatgatgcaccggaactgacgctcacacagggcgtgacagactatgacctgacggaagggatcacgtatgacagtgaaaaatataccttgtccgtcactgacacaggaaactttgacatcaatgtggcgggagattatgagatctcatacacactgacggaaaaggaaagcagtgtaaatgtaactgaaagtgtggagaacacagacagtgtagaaagcatagaaaatatagaaagcaccgagacagtgtcaggcacagaaacgatagaaacgacagataccacggcaacggtggaagatacggatcagacaccggaaggggatgccaccaataccggtgatacacaggaaaagcaggtcatcacctttacaagaacggttcatgtagtagcggcttctggggacgaagtacctgtgtatgtagcacgggaactggtgctgacacagggagaggaaggctacgacctgacagatgacattctctatgaggatgaaaaatatacactggaagtagtagaacttggtggtttcgatattcaagtgatcggctcctacgaagtgacctattcccttacgcctgtgacaacagaaggaacacagggaaatgaacagaatgacacacaggaaaatcaggtcatcacatttcagagaacggttactgtgaaagcagccgtggaagaaaacgctttgtatgaagcaccggatctctacttagagttgggacaggaagagtatgatctgacggaaggcattatctatgataaagacctttatgaagtaaaggtttctgatccaggagattttgatatcaatatgctgggggaatatgaagtaacctatgtccttgatcgtattggaaagtctgcaaaaggagaagataccaaaacttcaaaaccggaagaaacaacagtttctgatgagcagaagtcggaggataatgatggcatacaggctgctacccttgaactgtcggatgaaaaacagagtgtggagtcttcagacgatggtacggcaagtagcatggaagagaaatctcctgaagtaaaaactacatcacaggaagcagtctatttcaccagaaatgtatttgtagaggaatcaggagtaaactattcctttagaaatgcagtggcatatgcaaatgtacagggtaggtatactataaaattaggaacacccatttggatagatgatacgcataaaaagtttaagtatacaaatgtaaagattgacacagagggtgaagatatcagcctgatgacaatcacgatatcaacgggtaaacttacggatgatattttaaatgatgctacgatacaagatgatgttggacgttcagccacatggatttttacaaataaaaaaaacagtcaggaaatagaagaaaaaattaaatcttttgtttttgattatgcaaatgatataaaaatcagcgtatctattaatggaaatgataataaggggtttaatggagatttaagtaaattgaaattgacacaatggtcagagaatggacattattatttattttcaccagatattatatcttgggcaaatgcatatcttaaagctaaagattataaattagggggaatgcaaggatatctggctacatttacttcgacgaatgaagaattatatcttgttacgttaaatcaaaatctaggaacatggactggaggaactagattacttcttaagggcggtcagagaatagaaaactctatgtttcaaagaataaaaggtaatttaatagagggaagaacatattattgggcatcaggaccggaagcaggaagtgttgttccctcaaatttaggaacttcaagtaatagttttgatcagcatccagcagttgacggggctgtggataatacactatctgatattcaagggcatgagtcatgtttacttttaagagcaaatgataaaacactaaacgatattatcgaaggaaattataaaggtgcttcaaaggcatcagggatatttgtcgaattcggcggttatgatgagggagccgatcctggacagccggataacagtaaaaaaggtgaagtaaacgtagtagcagcaccgatggatgcggaggcatccattaacggtgtgaaatatgcgccccttgccgatgcactggatgctgcagaggagaatgatgttattgaaattgttaaatcgacagtgactccggttacagatggaatcctgaaaaagggtgtacaattaaagagtgaaggcagagtgaatgtctatacagctgatgtagattcaaaattggatgtggcagataacggaactgtcactctcaaagatggtcacattaaagtgagcgataatggtgtaaccttgaaggtggagagtccgatcgacaataaaacataccagataactactccacagggagctacagaggtgattgtgccggatatttcaggtggagatcagacaccgtacgtgatgaaccacaatacgaatgttcttgatctaaagattgatgatgtgacctattcttatacaaatgaaagctgggataaccttacgatggtatacattccagatgccatgtatcagaatgaaagagtgacaaaggcagaagttacggcagacaagagtgcagtaattaagctggatgacggcgaagaaaatacggtagagataaaaggaaatggttcagccgccgataaagtgacagtagagcgcagaacagataaaaaagcggaggtaaaacttccttcgggaacaaaggcgaaggtatttggacatgaggtggatactgcacctgcaggtggcgtgacggtaggtcagagaaatgcagtcgacacaaaatatccggacagggattatatcgtaatagctgttgcgggagagaaagtcacagtagatggtattgaatatgttgcagcggaaaacaatcagaagttttatcttggaacatttaaagcaatcgtaaccataggaagcaatgctgagattacaattggtcaggagcagactgatgttggttatttaaaaacttatactgtaaaaatcagtccaaaagcagattatgatctggatcaggacaattttatggttactatgaaggaaagcgatacagggactgttaagaatttgacatttgcagatgtgtgcagtgtaaatccggcagatggaagcattacagttacggttccaaatgtcagtggagacatcacagtgaatgctgcggcaaaacggcagatgacaaccttaaaagtaacaggtcttgtaacaggaaatgcaaagggaagcttcaaggcggtagatgcatctggtaatgaatacaaactggagcaggatggcagcatcaatgtaaaccgcaatgaggaactcacccttatatttacgccaaatgatttttcaaatccttattattcagatcttaccggggagaagggagaaagtttctctatcctgacagcattgcaggagacaacaaacaatacaaatttatttgcaggagcaaaaacgtttaactggaaagaaaagagttatgaattaaagtacacaccgacaacttcagatgtgacactgaaagctgtattcacaccgtcccatatcgtacatgttcatgtgacaggtggtacggcaaaagtgaaagatacagggcttgtaacaaaagaatcaggtgcggaccagttccagcatgtcattgtgaaaaacaatggaacagtagagctggagttaaaagatacaacaggaacagccactacttataaacaggcatattggagcaacgtggatggcagtgatgataccattgtatccaatcaggctttcacaggaaatggaacaagctatatttacacaacacgggcggtaggcaaaccacaggcattaaatattacatttgaagagggacagaccgtagatgtaaaagtgacacatggaaaccttgtgactggaaatgatggtgtggcatggaatgataaaggaaacagtacataccagacgattgtgaagaagaatggagcattgaaggtcaatattaagccagaggatggttacggattaaagagcattacggttaataatgtggcaattgatattgatgcggcaatcaagagtggggaaatcacatgggatggtacaacaaagacctattcccatacattcgcaaaagtttatcaggcatggaatgttacggtggactttgaaaaactgcatgagatcgtttttgaagatcaaaagggcaatatcttaaataagacagagcatattacagtgattgatggagatacgattccggcagcaagctttaccaaaatgcaggaagaagcagataagtcaaaggctgagaatgagagcctctttgtatgggttgataaaacagacagcacaaagatctataatgaaacaactgtgatgactgcacagactgcggatgtcgtgaccttaatcccggtataccggatgaacgtgatcaagggggcagatggaagcgttattgcagcagatgattttgtcattcatgtgaacgatgtcagaaagcttacggacacagaggcagcgacactcgcaaatgtgactgcttatgatcattccggttcagacatcagtaatagtgtgactgtggaacaaacaaaattagaggaattaaagaaaaagactaagggaacatatgtggatgctttgacctttatgattgcagcatcaggattgacgacaggcgtagaagtggaagtgacggatgataatccgaccattacgggaaagactgcatatacgctgactttcaagggaagagcaaatgagacttataagtatcaggagctggatgcccagggaaccccgacaggtaatgtatcaaccatacttacggatggggatggaaaagcaaccatcacgggtctgaagaaagcaacaccatatcagatcagtcataagaaatatggttctgtaaacggcaaaacagccctcgtggatgcaaaggatattgcaaagcagttcgaggacagaggtgccggggacacaacaggcaataatgccacggacaaaacagagaaagcggaaaactccaatgtacaggttgtagtggatgatgacggcaactacaaagtcatcgtgaagaaagacatcgaccacacagttgagatccctgacacatggggtgaggtcaagatcgacttaaatgataagaccatcacaggtgacaaggcagatgataataatgaggcaaaaccgggactggaatttgtcaaggatgcgaacagcaacgaacatccgggaacgaatcttgagatcgtaaacggtacgatcaaaggtggagacggttctgctaaacatccagatggagcagccggtatcggagccagtggtgatacagcagatgccggaattatcattggaagcaatgcaaacgtgaccggtggtaacggtgcagacggtacagaaggcaaagatggaggaaatggtggagccggtatcgatggtaacggcaagatcactccgacagtcagtggaactgtaactggtggcaacggtggtaaaggcggagattccgcagccggtatccctggcaatggtggaaacggtggaatcggaatcagtgcaggcgataagaccatcaccgtcaatcctggcggaactgtcaaaggcggtgatgcaggaaacggcggaaacgcaacaggagataacacgaacccgggcggcaacggtggaaacggcggtacaggaaccgagaccacgcagccgggaaagaccgataataacggtggaacaacatccggtggaaatggcggagacggcggtaaatccgacaacggaaacggtggaaacggaggaaacggcggcagcggctccacaggagaaaataataacaacggcggcacgaacagtggcggcaacggtggaaatggcggagactcagacaagggcaacggcggatccggcggtaatggaggaaactcaggcgaaaccggaggcaacggtggtaacaacaccggaggaaacggtggaaacggcggagactccaacaacggcaatggtggctccggcggaaacggtggagaatccaacagcggaaccggaggaaacggcggaaatggcggagactccaacaacggaaccggcggcaacggtggaaccggcggtgaatccaacagcggaaacggcggtaacggcggaaatggtggagactccaacaacggaaccggaggaaatggcggaaacggcggtgaatccaacagcggaaacggtggaaacggaggcgatggaggaaacggcaagaacccgggcaccggcggaaatggcggcggctccaacagtggaaacaacggcagctccggcagtgatggcaacagacctggaggcaacggcggtaacaataacggcagcggcggtaataacggcagcaataatggcggtaataattccggtaataacggtggaaacagcaatggaaatacgaacggaaccaataccggagtcacagatggcaagaccaatgccacagatatcgccgcagcggatggaaacaatgcgtccggcggaaacaaaaacaacaaacacaacaggaacaacagaaacaacaacgagtcagaccaggcggatggtgaggatgtgacagaaggtacagagaccggtgcagatacaggttctgatgatactacagatgtcgcagacagcacagagaccggagcagatgcagacggaagcggaaacacagacgacagcatcccggcagacagcagtgatgcagacggacacatcagcttcgcagactgcggattccactggtatccagtcatcctgatccttgtgatcgcaggatacacagtcctgcgtatccggaagatccgcgaggaacttgacggagagtaagacagtaaccccaaaagataccagaacgaaaaaacaatcccggggatatccacatatccccggacaataaaaaaagaaagacctattatctaaacttacaaacaacaaaccaaaatgatatatgtaatttttccaaaatacttacaaaacatctgacatgagcgggcaggacaggaaagatccctgtcagacccattcatggcagaaatacggggaacaggaggataaggaccatggatcctgaaagaagaaaagcactgcggaagacgcagaaaaaatgtatcgcagcccaggtggtgatgtgtgcagcctatatatcagcgggcatcttactggctgtgacaggcaggcactgtgtggcagatactccgatctatatagccggcgcagtcattacagccggctgcatggcagctcttgcagtgtttgagtcaagactttcaagagaacttgcaggatgacatgacaggggcagcgcaggctgcccctgttgtgcctaaaaaagggattataaggaagtgacagatcatgaaagacaggaattttgttaaggaaatagaaaagttaaggacagccgtcttagggtatgaccgtgaggaagtcgtgctctacatcagggagctggtggagtactatggacagaagaacggggaggcagtgagggaactatatctggaaaagatgcagcttgcggcagagaacgcaggactgcgggcacagatccccacacaggagaagctctatgcggaggcagaaggaaaggcggaggagatcctgggcggtgcaaaggagactgcggcgaccatcctcgaccatgccggcaccgaaaaggaacgcatgctcagagagaccggggaagcagaaaagcggatccttgcagaagcggacaggaaggcaggggagacccttgcagaggcggacagaaaggcaggggagacccttacagaggcagagaggaaggcaggagagatccttgcagaggcagggcggcaggcggaggagatccttgcagaggcagggcggcagatggatgtcatcctgacaaagacaagggagaaagtggagaagcaacaggcactctaccatcagtaccgtagccgtctggaagccttgaaaaacggcctggactgcatctttgcagggtgtccgccggaggaagacacccgggatctgcatggaaagccacagagaccgggacagatacaggcagacggaccggaagaggccggtctccgggaacagccatgaacgggggagaacagtacagccttgacatggcactcctgaagatccgcgaggaaaaacggaaaagaaagatgcgctcggagcgggccgtcatcctgttcgtggtctggctcctggtgttcagggtatgcgggatcatgcgcgtggatggaaattccatgcgccctgcctgccatcccggggacatcgtgttcttcctgcgcatcctcccggacggcgtgggctatggggatgccgtcatcttaaaggatgcatccggggaatacctgatcaagcgcatcgcagggctgccgggggatgtgatggaggtggaccgtgagggacacctgacaaggaacggcgcagaagtgcaggagacggatgtcatctatggcatgtcggagacaggagacagcgtggattatccgtacaccgtgccggaagggagttatttcttcctcggggacaaccgcccggtgtctttggacagcaggatgctcggtgcggcaggaagggaagagataaaaggaaaggtcatctgggcagcgggggctgggagatggaacaaaaaacaggcaagaggtaaaagaccatgagcattacaggagcttatacttgggaagatatttccagtcttgggatggaagcttatttccagcccatctacaacgtggaaaaacacaggatcaccgggattgaggcgctgttccgtgcaagggacgggaagggaggtttcctcgacccggagagccttgtgcaggaggcagaggaatgcggctgggtgcatgaaatcgacctgtggatgatccgggagtgctgccggtggttcacgaggtttgcggaacacggcatcacgaggatcaacgtgaacctgtcgccgcagacctgcatggtggagactgtctgggaggagatcagcagctgcctggaccggtacggcctccagcatgggaagatctggctggagatgacggaactcgggaagtcggcggataacggaaagctcctggagaccgcacacaggctgcaggataagaagttcaacctggtcatggatgatttcggcaagggcgaatccaatttcgtgcggctgatggatttcgagttccagagcatcaagctggacaaggagctggtctggggcatcgggagcaggaagatgggcatgccgatcgtgcagacgctcctcgtgttcgcccagaggaaccacatctgggtgacggcagaggggatcgagacaagggaacaggcagcacagctggaaaagctcggctgcaactttttacagggctacctgatcagcaggccgctcccggcgcaggaatgcgtggaatttgttgcagactgggagaaaaaagacatccttgcacagtaaatatcatataaggaacaggagagataaatcatgggaaagacaaaatttggaacaaagattgtattcgtttttgtgatactgctcggtgcaggggcagtgttatatgcgaaaaactgcatggaacagcttgcagcatatgcagtaagcctcatggacggtgcaggacaggcgcaggcgcagagccagcttgcggcaatgatcgcttccgatgtgaaaaaaatggcagcctttatggcagccgggcttatcatcacgatcgttgtgggtgctgcaggcatcattgattacatcaggagccttgatcttgcctgcagctattcggacacactcgcacagggcgatctcacacaggatgtggaacagaaatatttagacaggaaagacagcatcggaaaccttgcggcagctttccacaagatccgggagagctttgcgggacaccttgggagcgtgaaggacaatgcagagtccctgagcggccatgtctcctccatcgggaaaaacgtggatgagatcaacggcgagatggaaggcatttccgcaacgacacagcagcttgcagcgagcatggaggaatccgctgcatccgcaacggagatgaacaccatgtcagaggagatcaaccgggcgatcaaaaacatcgcggagagcgcacaggaaggtgcggagcgtgtcaatgacatccatacccgtgccgtcaatgcgaagaaagagaccacggagaaccgtgccaatgcacagcgcatgcacggcgagatcaaggaaagcctcgaccaggcactgcaggatgtggaagtggtatcccggattgaggtcctggcacaggcgatcatggagatcaccaaccagaccaatcttttatccttaaatgcttccatcgaggcggcgcgcgccggggagatgggaaaagggtttgcagtcgtggcggacgagatccggaagcttgcgacggaatccggtgagacggcgacaaccatccaggaggtcacggacagcgtggtgaaagcagtgaaccagctcacaaaggacagcagacgtctgttagacttcgtcgcaactgatgtgaaatccagctatgacagctttgagagccttgcggatgcctacaaccgggattccgagtttgtggacggtcttgtatcggatttcagtgcgacatccgaggaactcttagcttccatggacggcatgataaatgcgatcgagggcgttgcaaatgcggcaaacgagggcgcaagcgggacctccgacatggcagagcgcatccagaacatcaccatgcggtgctccgaggtggcagagaccacggaacaggcaggcgcagcggcagaaacgttaaaggctgacaccgggatcttcaaggtgtgagaaaaagcaccggcagaaaacagcagccatcaggatggaacgcatcattgaatcaatggagaaatgggaggataaacgtgagaaataaaaagagaatgcttgccgcaggacttatagcagtggcacttctgtcaactgtgaacggatgcggcagtacaaccggaaatatgcaggataccaagggcatacaggggactacaggagtagctggtgggaccgtgcagggttccgggagcacaggaactgcatcagacacggcgtcacagaacaacagcaatacagcagatcataatgcacaggataacagcagtggaacaggaacagcacaaaacggcagcaacacaacagatcatacagcacagacaggaaacaacgacagcagcggaacatcacaggcaggcgtgtcacaacatgcaaccgcaggttctgccacaatggtgaacggcggcatcacggaacaggaagcgaagaacatcgcagccgggaatgcaggggtcacagaggaacagatccagtacatcacggtaaaacaggactgggatgacggccgtgccagatatgaggtggaattcaccgcagccggagtggagtacgattatgagctggatgcatccgacggacgcatcctttcggcagactccgaagtgatagacaagggataccgagcatcacagaatggtacgacaggttcccagaacgcagccggcacatcgcagacaacaccgggcggtgtttccatcgagacagcaaaacagaccgtcatggacaggatccctggcatcgatgccggaaacatctacatccatccggactatgatgacggcatctctctctatgagggggaagcctactatgcagaggtaaagtatgaatttgagatcaacgcagaaaacggaaacatcatcagctgggaagcagaatccatctacgactgagaaaaagccgttaaaagtaaaggttgagacagtcctgatcatcattgccatgacagggcttgtcctgaccggcatcacgatcgggaacaggatacaccatcatcagatgttaagggatatccgtatcaggttcgagcagcttcatgaccggatcgaagatcaggacaccgatacaaaaagtgtttgaatttggcagctttggaaatgaactcagaccataacagaaattttaaagtagaagcactctaatagaatgagcgatcagatgagaacctgattagaatccattctattagggtgttttttagtaaaaaataactttcgatttcacgtaagttcattgtgtcgttttatgtcgggtaaaatgaaaagaaaatgttaagagtcaaaataaggtatggaggggattagaattgcaggatgataaaatgccaaaggtgtttatttcatattcttggagcagtgatagacttgtactagagcttgctcaacgcttaatttctcatggagtggatgttgtgcttgataaatgggaactaaaagaagggcaagataagtatgcatttatggaaagatgtgttaatgatcctgacattacaaaggtacttataatttgtgatagggtatatgcacaaaaagcaaataatcgaacaggaggtgttggtgatgagactgtaattatttctggtgaaatatatgggaaaatgaaacaggaaaaatttattccaatcattgctgaaagagatgatgagggaaatgagtacttgccagcctatataaaaacgagaatatatatagatctttcagatacaataaaatatgaagaacaatatgaaaaattacttcggaatctatatgaaaaaccacagcttgtgaaaccaaaattaggaaaaagaccagagtggttggatgaggaaaagacaaatttttttccgttaaaagatttaattcgtcagattcatggaagtaatatcttaaataaaagaagaaattgtatatcaaggtttcaggaagcatatattgatgcattaaaagattattataaaggtgaaatgaatcccaaagaggtttatgatactttcttaaatatgaagccaattcgagatatatatttagattttgtagagacagttgcagaaatggaagatgattatgcagaagtgttagcagaaaatcttgaatacatgtataacaaattatgttgtataagaacatttaatgaaaatgcaaattcagtatgtgaaaatgacttagatatatataaaacacttttgtgggaattgtttatttgtattatagtgtatatgaggcatattaaagattatgctgctatcaatgtattattgacttatacatattttttggaaacaagtttatttggaggagtaattaaacaggctaattatactgcatttcaacattatagtagtgccattgaagaacattataaacaaagatcagatatgaaaaataaatatactttgatgggagatataatatgtaatcagagggagaagcttccaatatatacatcagaagcgattgcggaagcagatctgtttttataccaagtatgcaatgcttacgaactagtagaagatgaaaaaagttggtatggtatttattggtttccaacatgttatatatatgttcagaataaacagctggaatgggaaagaatgaaatctcgcagatattgtaaaaaaatgcagattttatttggggtagagagcattgatgagttaaagaaaagaataggaaaatgtgtatatgattcgaaaataaggtattacaatagtttggaagcagtacctgcaattttaaattatattaaagttgatgatataggtagtttgaactaatgaatgaaaaataaagtactttaggagcaaagaagattcaagatagaataaaaaaattacctgattatgaatatgttatcatatttgttgataagttattttcaaaaatacgaatttggatcaagaaatgatgtgttaaattctttttcaatgcttccacctataatacgatataaagttttgctgtttttgcataaaaagtacccaaagaatatttcaattattgataagttggtattggcaattgtgaagacctttaatgttgatgaagcaactgcatgggttgaaggaaagaaacaggatttaattaaattggatacagtgacagaaaatgcatttaatgagatatctgaaaataagggcatagagatagctaaatttatcaagaatatctcacctgataatatgtatatattatgcaaaagtaagatttcagaagtaggagaactggttaacagtaatagtgctttatatttagattttgaaagtgcttttccatattatgagaaaaatggaatattaacaggaaatgatccagagacaacagaatttaatgatattatgaattttttgtatatgggaagaaaaaattaaagaaatatcaaatgaaagtaatccgtatgtgatcttaaactttatgttttaaaaagaggtataaatgtcaaaatcaaaatgtaagaggaaaattataattaaaagaatttgaaatctttagaggtgggggagcgcaaggatcagccatatcctgcgaaatcccttttataagggcgcacatcttgtctgccggacgcaccagaaaggcatccgctccaatacctatgacattatcccccgtgaggaatgggaggtcattgagggctgccatgaggcgattgtgacgccggaggaatgggaacaggtgcaggaagtcaggatcgtttataactttgtcggggaaatcccggagattgcaacataaaaactttaccccatccctaaacaaccgagagatggggtaaaattttttgttgatcagaaatgtaaattaaaaagtgagtatgggaaaaatgctctaaaaaatgcaaatattgtttgcgggaaaagtctcaccgcttatgagaatgttcgtaatcagttaatgcctgtaaagctttgggagctaatgggaacagtgctatcatgttaaaaattgtcatcagaccgaccccaacgtctcccaaatcccatacaaactgatatgctgcaatgccgccgataaagagcattacaagggccagtaccttgtagagcgtctgagagagccagttatcgccaaacaaatacgccacatttgatcttgcataaaacaaaattcctaagaatgtggaaaagctaaataaaaacagaattagtgcgatgaacacaacaccaaattcgccaaaatagtatgccatagcagcttgcagtaaatccatacctgctaacccctcggttaattcctgaggcactaagagcataatcatcgctgtacaggtgcagattacatatgtatcgatgaatactccgagagcctgaaaaagcccctccttggcaggatggtcgatatccgcagcggcagccgcacagggggcggaaccagatcctgcttcgttagagaataatccacgcttcgcaccgttcatgatcgctgcgccgatacctccaccaacagcttgccgcagaccgaacgcctcgctgaaaatccggctcaaaacatcgggaagctgaccagcatttttgataataatgaaaattgtaaggaaaaagtaacatgcggccatgattggcaccatgatatccagaactttgacagtggcgtttttccgcaacacaattatcgcagcaatagcaactagaaaaattgtggtatacagcggaggaatgtggaatgcattttcaaaagaagatgcgaccgagttgctgatcacctgactgattccacaccagcagagaagcccagataaggcaaacagacatgcgaagagggaatatctttgtctcttactccttgatgcgaacagtacgtggagataatacgccggaccaccacggtaaccaccatacagcggatccttttccttgtagatttgggccaaagtcgcctctataaaggcagtagatgcgcccaaaagtgcaatgagccacatccagaatacagcacctgcaccgcctgcggagatggcagccacaacgcccatcagattgcccatgcctacgcggcaagccgtagatacaatcagtgcctgcaagccagagataccgtcagaatttttggttttgttattctctagtgttatacggatcatttctgggaacattcggagaggaagaaagtgagtgcggatcgtaaaatagattccggctggcaccaaaatcataaccagaagggatattcccagtgtacttcctcctggaagcgggatctgcaccagatctccccataaaaagttataaattgcattaattaatgatatcatcttaaaaaacatcctctcatgatagggtaaaatttccaaatacaggtaccaggactcatttggcagacatgtgttctccctattaaatgttgcttcttatgtcgcttcttctgttctgcttatgaacactttaaaagattcgcacatattatagttgacagaaaaaaattactaccacttaaccagttgttgcaccttctggtttgcctcttgtaaaacggcagcagacgcaagcaacgcctgatgttcctgatttgtcaggtgatactctaccaactctcgaataccagacccattcagaacagcgggaatacctaaatagaggtcggagagtccatattccccatgcggcatgacagacaggggcataacaatgttttcatcctgtatgatagccttgatcattcgtgctgcaacagcagcaataccataattagtagcgcctttctgttttacaatctgataagcaattttggcaatttcttttctaattgaatccaactccacataacgaaacctctccgggctatctcgcaggatatctataatacgctttgcgccgactgttacttggctccagggaatcatttgtgaatctccatgttctcccatgcacatggcctccaggctgcgggcatcaacaccaatcaggtcagccaaaaaataacgcaggcgtgcagaatccaaggcggttcctgttcccataacctttgagtccggcagaccggagatacttttgaccagataggtcatagcgtccacaggatttgtgatgaccagaaagattccatgaaagccgctatccataactgctctggtgatggaagctacaacagtagcagcgttttccaacatgtccagccgagtcatgccctctgtataggggacgcccacagccaatacaacaatatctgcatcaatacagtccgaatatgttcctacactgatttggatattactatcgtaatatcccacagagtgattcaagtcggtgacttctgcccacgctttttctgcatttctgttgattagcactagattgttgcaggtgttgcagattacaagatgatgagccagagcagtacctacattgccagcaccgataatgacaactttgcttcttccaatagccataaaatcctcctaattcgaagatgtacagttgaatttcctgctttaatagtgtatcataggattgatgattaaggaaacaaatgatttttattattataattatattttttaattaagggagaaacatggatctaagattgttttccacctttctaagggtggcagaattgcagaattttacaaaagcggcggagcaactaggttattctcaggctactgtcacagttcagattcaccagctggagcaagcactggggatccagctttttgagcgaattgggaaacgagttcggatgaccgagcatggagaacagtttatcccctatgccatagagatattaaaggctgaacaaaacgcaaaagattttcttcgtgaaccagaaaatccttcaggacgtttacgaatcggtacggcggaatctcttctgctgagcgttcttacgcccattctgatggaataccaccatcgttatccggatgtaatggtcagcatccacacaggtttgattcatgaactgttcgatatggttcgacagaatgatgtggatcttttattctttctggacaagaaaacagattttgcagattgggtcaagttgctggaacagcaggaacccatcctatttgttgcttcccacgatcatatgatttgtcgcaagaaaaaagtatctttagcggaagtggtgcgcgaaccctttgtgctaacggaaaaaagtgtcagttaccgctatgatctggagcagcttctggcggaaaaaaagctggaaatacacccttttctggaaaccggtaacacggacatcctcgtcagaatactgcttcatggcaactgcttgtctttccttccgcaatatgtggttcgtccttatctcctatccgggaaaatgcaaaccgtagatgttgaggactgtcgtattcagatgtggagtcagctggtgtatcacaaaaacaaatgggttacaccccagatgaactgttttattacgctcatgaaagaaaaaatgggtaaagtaatataatgctttttatagctcttctcatttcagagaagagctatttttatgctcattttaaatttaccgcttgacattgtggcaaagatttggtagctttcggttgtctggtattctagtattaaaaatacttgctattccccaccaaaaaaaatcctttgaaaatcccatcaatatttgctataataacaaatgcatctatgcatgatgcaaatatactataattagaaatcgaggaatgtaacatggcattattggaacagtggcagaaagttgcctataatgagaaagcagatagaggtgaattacagagattctggcagagatacttccttttagagaagggcgtatacgaacagcttttaacaaatcctgatgagaaagtagaaggaactgtaaaagagcttgcagagaagtacaacctcagtgttatggagatgacaggattcttagacggaatcaacgacagcttggttgaggctaatccaatcgacaccatggaagaagatacaaaagttaaccttgtttttgacaaagaaaaattatacaaaaacatggttgacgcaaaggcagactggttatatgaattaccacagtggaaagagattttcgatgatgagaagagaagagctttattcttggagcagaagaaatccggcactgttcatgtaggcaaaaaagtcggacgtaacgatccatgcccatgcggaagtggtaagaagtacaaatactgctgcggaagatagtccgccgtatctgaaatgtaaaaagtactttacagatagaagaaaagggtatagaatgacactagtcaaaacgatgaagagaagagtagcataagcaaaagtcccagagaggaaggcgtttggtgtgagcgttccggctaaggattatgtgaagaccaactctgagtgaccccaatccggtccggtgataccgttacaatcaagaatgagatttctctggaatggacaggcagtaagaagattgatgtctggtaagacggagagatgaagatgggtggaaccacgataagtatatcgtccctgatattgtaggaatgcagtatcagggattttttatgttgtacagagaatcggagatacttcctacagaaacttatttttatatagcgaaaggaaatgaagaaaatggtagattttaaagcagacgagagactgaatactttaaaccattcctgcgcacatgtgatggcacaggcagtaaaacacttatacccacaggcaaagttctgggtaggaccagttgtaaaagaaggtttctattatgatattgaccttggcgatgatatcatcaacgacgaagcaattgcagcaatcgagaaagagatgaagaaagtctgcaaagaaggcaagaagatttacagacgtgagatttccaaagcagaagcaatggaaatgttcaaagatgatccatacaaactggacttaattgaaggtctggaagatggaaacatttctgtttacgatcagggagatttcacggatctctgccgtggacctcacgtagacaatacaaagttatgcaagaacttcaaacttgtaaaatactctggtgtatattggaaaggtgatgcaaacaatcacgtaatgcagcgtatttacggtgtatgtttcccgacaccggaagagttagaggagcacttaaaactccttgaggaagcaaaagaccgtgaccacagaaaaatcggtaaagagatgaatcttttcatgtcggatgaccttgttggacgtggacttccaatgttccttccaaaaggatacacagtatggcaggaacttgaaaattatatcaaagcaaaagagagaaaacttggatatcttcatgttatgacaccttgtgttggtacggttaatctgtataaaacatccggtcattgggatcattacaaagacaatatgttcccggctatggaagtggagggagagtctttcgttctccgcccaatgaactgcccacatcatatgatgatctatgcaaacagaatgcattcctacaaagatcttccaatccgtatcggtgagatcgcacatgacttccgtttcgaagccagcggtactttaaaaggtatcgagagaggacgtcatttctgccagaacgacgcacatcttttcgtgacaccggaacagattgagtcagagttctcacaggttgtagatctgatttttgatacttacaaggatttcaacatcacagattaccgttgcgtgctctccttaagagatcctgctgataaagtaaaatatcatgatgacgatgagatgtggaacacagcagagaatgcactccgaaaagtattagatgacctcggaatcgactatacagaggaaatcggtgaggctgcattctacggaccaaaacttgacgtaaacgtaaaaccggcaatcggaaatgaatacacactttccacctgccagcttgacttctgcttacctgcaaaattcaatctgacatacattgacaaagatggcacaaagaaaacaccggttgttttacacagagcaatccttggttcccttgaccgtttcatggcttatattttagaggaaacaaaaggaaatctgccactctggttagcaccggttcaggcaagaatcattccggttaaaaatgaggatgaagagttgaatgcatactcacatgaacttctcagctatctggatgagaacggtatccgtgtggagattgacgagcgtgccgagaaacttggctaccgtgtaagagctgcacaggtagagaaagttccttacctcatcattcttggaaagaacgaagtaaaagacggaacggtaagctacagacttcatggcgaacaggctaccacaacagttccaaaagaagagttccttgcaatgttaaaggatgagatcgcaacaaagaaaatcaatcctgccgcattaaaataaaatttaataaaaaattgaaatgaacgaagagcgtatgccagaaaattatggcatatgctcttttacatatttttttcgaaaactgccatactaatcttagacaattgcgaaactcatgaaaacctaagttgaattgtgaaaaattaacaaaagacatgaaagacattggggaaccgccggttcttagaaggcaggtacaacttttttcaatcaggtctgtgcatttactgcacagaccgtgcgaaagtgattcaagtgtgagcaaattcctatctgcgaagcagattttaaatgaatttgcgaagtactgcgaagaatgagcagtaccgttgcgagtgacacatagcgaaagcgtgtcttgaatgtttttgttaattttgaacaatttaaagaagattatgaggagtttcacaattgtctgacagatttgaaggaaaaggagaaaaaagtatggcatatttggattgttcagtgaaaagctgcacctacaataatgaagacggctgttgctgcaaaggcgacattcaggtggagggacgcgaagcaaccgaagcacagagcacctgttgcggaagtttcaaagaccgcggaacaaacggtgcagcctgtaacgcattaaaagatgtttctaaggaaatcgacgttgcgtgtgaggcaacacactgccgtttcaatgaaaatgagaaatgtcacgcagatcatatcggtatttccggtgccggagcctgcacctgtggagagacagagtgcgcaagcttcgagtgcaactgtaaatatgaataattaatacaggtatgaaactggtctgcacatgctccatttgtgcagaccataaaaaagcaggataagaaaatttacatctgtaaagcaggattccagtgctttaaaacacaaaaactacacaaaaagtttacaaagatacccttgtttcttttgccgcggagatgtagtatgggagttggaaaaacaaaaagattcctgtttggaggcggtacttatgagaaaaaaatcacatatttcactggcacgttacattgtaaataatatggaagacaatgatctgaaaaaacataaattatctttttacatcggaagtgtcctgccggacattaagccatctttcgtctataagcgccatgagatggacggaacttacccggatatcagacgccatattgagcgcctttccgagggcaggaaactggtggagaagaaaaaagggcgcaagtattacatggatcttggacagatcagccactatctggcagattattttacttatccgcacaataaaatctatccgggaagtctgaaggatcactgctcttacgaggaaaaattaaagcgggatctgcggaaatatatcaggacggacgctgcaaaaccgcataaagcagatcatctggaatttaacagtgccagaaatctttgcgattttatccagaaatcccatgatgattatcttgtgagaaagcatgatgtggaggatgatatccatcacattgtggaggtgaactacaaggcaatggagacaatgatacatttactcgccgagaaaagggcagaattccggttaaaacattcctgaaaaatgaaaaacatacaaaaacgataggaaaacatacgaatcaaatattaattttttatgaacagcgcatccaaagtcgaaaaatggatgcgctgtttttgtgggaaatacgtgcaattgtgaaaaaatccgtttggaaatgtcgaattttggagaaaactcatcacctaattcatttgatttttgaatctgcggatagtaatatggagaatataaaagagaggaaaagaaaaaggggaaaagaaaaagggactattctctgctccggcaattagcagaaatttgaatttgtaaaattgcattttccattgaggaaatcaggaggattcatatgagaaagttgagtgagttacagcaggaaatcgaatccgttcgatttgaactggatcaggcacttttacgacaggataagtttgataattactatcaaaaaagtacaaaactcgatcagctgattgaagagtatatcgaggaaacagaaagaagtaagtagagaagaatggaaaataatgccaaatcaggaaataactggtctggcattatttttttgctctaaaatattgattttttcttaagaatagtctaatatatgtttaaaagtggtggaaagtggtagagaatggttcgaagtggtggcaaatgaccacagaaatggaaaatcaagaggaaccagctgccgcacaaaggcaggtgattgtgtcatgtttatgggagaatacaaccacacagttgatccaaaaggcagactgatagttccggcaaaattcagagagcagcttggcgatgaatttgtagtgacaaagggacttgatggatgcttatttgtgtatacgtcagaagaatggcacaacatcgaagagaaattcagaaacatttccatgacttccaaggatgcaagaaagttttcacgtttcttttttgcaggagcagcttcctgtgaactggacaagcagggaagaatccttcttccaccagttttaagagaatatgcaaatctgacaaaagatgtcgttttagtcggagtcttaagcagagtggaaatctgggacaaagacagatggcaggagaatacatatgatgaagatgagatggatgagattgcagaacacatggcagatttagggttcagcatctgatccacagagaataaaaaaagagagccagagcaaaagtcaggcagagaggatcacaatggaatttaatcattattcagtattgctaaatgagacaattgaaaatttgaatatcaagcctgacggaatctatgtggatggaacacttggcggtggcggacatgcttatcaggtggcttcacggttatcagaaaaaggcaggctgatcggaatcgatcaggacgcggatgcaatcgcagccgccggagaaagattaaaggaatttggtgacaagatcaccattatccgaagcaattacgccaacatgaaagaggaacttcaccgcattggcgtggaaaaggtggatggaatcgtgttggatcttggcgtatcttcgtttcagttagatacaccggagcgtggttttacttaccgtgatgagaatgctccacttgatatgagaatggatgacagacagagcctgactgcaaaagatattgtaaacggatacagtgagatggatctttaccgtatcatccgtgattatggtgaggacaagttcgcaaaaaatattgcaaaacacatcgtgcaggagagggcaaagaaacccatcgagacaaccggagaactgacggagatcatcagggcttccattccaatgaaagttcaggtgaccggtggacatccggcaaaaagaacgtttcaggcaatccgtattgagctgaacaaagagttagaagtactgcagaataatctggatgatatgatcgaccttttgaatccgggtggaagaatctgtattatcacgttccattccttagaggatcgaattgtaaagacgaattttaaacgaaatgagaacccatgtacctgtccaagcgattttccagtgtgtgtatgtggtaaaaaatccaagggaaaggtagtcacaagaaaaccgattcttccttccgaggaagaattagaagtgaactcccgttccaagagtgcaaaattaagagtttttgaaagggtgtagcagatgccgaacagaacagtaaatcacaacaatcgaaatagagcagcatatcaggtagatggcaacaccgtacgccgtatggaggcgatgccggattaccgcaaagagcgcagagacagacaggagcgggaacgcgaggaagagctgagaaaacgcagacgtgccgcagccagaaatcaggcaaaagcgcttcgcatgagcaaaagttatgttgtattcctgacaatggcagtgaccgtatttggcattttctgtggagcttatattaagcttcagtctgatgtgactgcaagaatgaaaaaaatagcaagcttagagagccaggtgacagaccttaaggctgacaatgacgaggcttacaagagaattaataccgcagtagatctcgatgcgatcaaggagaaggcaatcaatgaacttggtatgttttatgcaacacaggatcagatcgtctactactctgtagataagacagactacatgaatcagtataatgaaatcccgcaatagggggattttcagacaaaaaaataattcaggtggtagaatggcaaaaagaagaccgaaaaagccgatgttaaagtttccaaagcgtatgcagaaaaaaatgatcgtcatgtttacggttgttgcagcgcttatgatcggactcatcggaagactgatgtatattgaatacaccagtggagaaaaatatgagaaaatcgttctggcacagcagggctatgacagccagacaattccttatcagagaggtgacattgtagacgcaaaaggaactgtgctggcaaccagtatcgcagtttataatgtgattctggactgttccgttttaaatgatgatgaaaaatatgtggagccgacgatcaatgcgcttgtaagctgcttcccggatctgacgagtgaacagctttattcttatctgaaagactctccggacagcagatatattgtgcttgccaaacgtttatcctatgatacgatccagccttttgtgaatctgcaggaggagcgggatgaaaagggaaaactggtcaatccatatatcaaaggtgtctggtttgaaaaagagtaccagagacaatatccatatggaaaactggcaagttctgtgatcgggttcacaacatccggtaacctcggaattaatggactggaaaattattatgatgatacgttaaatggaattaacggcagacagtatggatatctgaattcagacagtaattttgaaaaaacgatcaaaccggcagtcaacggcaatacgttagtgacaacgatcgatgcgacgatccagtcggtggtagagaagaaaatacaggagtttaatgaggcctatacagatggttacagagagggtgagggcggagcaacaagaatcggcgtgctcatcatgaaaccggacaatggcgatgtccttgcaatggcacagtatccaaactacgatctgagcaatccatgggatttatctgagtattatacacaggaagagatcgatgcgatggatgatgatgcgagactcgaagcgttaaatcagttgtggcagaacatatgtctgacctatacttatgagccgggatcaacggcaaaaccatttacggttgcagccgggcttgagacaggaacactgtcgaccaatgatacctttttctgtgatggagccgaacagctcagcggatttaccgtaaaatgtgttgcctatagaaaaggtggacacggaatgcagactttggaacagacattgatgaattcctgtaatgatgccctgatgcagatgtcctaccggatcggggcagagaatttcacggagtaccagcagatttttggatttggacagaaaacgaacattgatcttccgggagaatcgagaacagattccctgatttacacattggatacaacatcacagctgagtcttgcaaccaatgctttcggacagaactttaataccacgatgatccagcttggaactgctttctgttctctggtcaatggcggtaagttatatcagccgagagtggtaagcaagatcacggatcagaatggaaatacgattcaggatatttctccgacgttgctgcgtgaaactgtatctaagacaacaagtgatacattaaaacaatacatgtactcaaccgtgacatccggtaccggaaatacggcaaaagtagacggttactccatgggaggtaaaaccggaacggcacagaaagtgccgcgtgatggtgtgaactatctggtttcttttatcggttttgcaccggtggacgatcctcagttaatgatctactgttttgtggatgagccgaactcgcaggatcagccacacagcacatttgcacagaatattgtgagggagattttagaagaagtacttccttatatgaatatttatccggatgaggagacgacaggcttacattctgggtgggatattaccggaacggatacaggcgcagccgctgtgacagaccgtgtgacaggaaatattccggaggaagaaccggaaggaacggatgatgtgccggataccatggaggatattccgggagccggggaaaacaacgaagaaaacgccgaaaatgatggtgtaaatgccgaagaagcaggaacaacgtccgataacagtgaataaaaacataacctcataaaagttggaataaaatgcaaggaagacttttatgaggtttttgttttatgtatcggaataagacctttaaccgcaaaaaggtaatgatcgtattcgtggcagttttttttatcatgatgtttctgattggaagactggtatatctgatgatcttctgctccgaatattatggaaataaagcggagaatcttcatgagagggaacgtgatattaaggcggcacggggaaaacttttggatgcaaacggcacagtgcttgccacaaacaaatctgtgtgcacgatctccgtgatccataaccagatagaagaacccgagaaagtcattgagatgcttgtgagagaacttggtattccggaagagactgcgagaaagcgcgtggagaaagtcagttccatcgagcgtgtgaaaacaaatgtcgcaaaggagaccggggatgcaatcagagcctatggactctccggagtgaaagtggatgaggattataaacgatattacccttatgggacgctcgcttccaaagtgcttggatttaccggagctgacaatcagggcattttgggacttgaagtaaagtatgatgaataccttcagggaaccaacggaaaaatcctcacgttaaccgatgcgaggggaattgagatcgagaatgccggggagagcagattagaacccgtgaacggttatgacctttgcttatcattagattacaatattcagatgtactgtgagcaggcggcaaaaaaagtctgcacgaaaaaatcggcggacagtgtttccgtgatcgtgatgaacccgcagaacggcgaacttatggcgatggtgaattatccggagtttgacctgaacaatccgtttactctggctggggacaccggggaagctgtgtcagcggaagaaaaacagaatctgttgaataaaatgtggcgaaaccagtgcatcagtgatacctatgagccgggttctacatttaagattattacggcagcggcagcgttagaagagggagtggtaaaactggacgatgcatttttctgcccgggttataaaatagtggaggacagaagaatccggtgtgcgagaacgacaggacacggggcggaaacattcgagacagggatcatgaactcctgcaacccggtttttatggaacttggcgagcggttaggcgcggagaactttgccggttacttcaaacagttcgggctgttatccaaaacgaatattgatcttccgggggaagcgggaacaatcatgcataagacggaaaatattggaccggtggaacttgcgacaatctcgtttgggcagtcgtttcagattacccccatccagcttgtcacaacggtatcttctattattaatgggggaacgcgcgtgacaccacattttggcgtaagcgtgcaggatgcggacggaaatacagtaaaaacgttctcctatgaaatgcatgagaatatctgcacagcagaaacttcggaaacgatgcgctatctgctggagaaagtggtgtcagagggaactggtaaaaatgccaaaattgagggcttttccatcggtggaaagacagcaacttcacagacacttccaagaagcgaccataaatacatttcatcgtttctcggatttgcgcccgctgacaatccgcaggtgcttgtgcttgttgtcatcaacaatccgcaggggatttactacggcggaacgatcgctgctcctgtggcgaaggaaatattcgaaaacattttgccttaccttgataaatgagatgaaataacgtatactagttaggcgaattgaacgttagaaaaaatacaagaggtgtttagtcatgaattatgaaatagtgataccagttttgatctcttttgctatcagtgccattttaggaccgatcgtgatcccttttttgaaacggttaaaggtggggcagacagagcgaaaagagttggaatcccatttgaagaaaaacggaaccccgactatgggcggacttatgatactggcaagtattatcattacctcactgttttatgtcaaagattatccgagaattatcccaatcctttttatgactgcaggattcggtgtgatcggttttctggatgattatctgaaggtagtgctccgcagatcagacggactgctcccgtggcagaagatgatcttacagtttgttgtgacaaccgtgtttgcagtttatatggtgcggtattccgaaattgagcttaccatgctgatcccgttttccggtggaaagtacttaaatatcggatggcttgcgattccgctgctttattttgcagtgatcggaaccgtaaacggtgtgaattttacggacggtgtggatgggcttgtgtcgagcgttacgattatggttgcaacctttttttcagttgtggcgatcgggacaaatgccgggatcgctccaatcacctgtgcagtagcaggagccctgcttggatttttattatttaatgtatatccggcaagcgtttttatgggagataccggttccctggcactgggcggctttgttgtggcaactgcctatatgctccagatgccattatatatcctgatcgtcggactgatttatctggcagaagtcatatctgttatggttcaggttacttattttaaatacactaagaaaaaaacaggtgttggaaagcggattttcagaatggctccgctccatcatcattttgagcttggtggatggtcagagacgagagttgtcgcagtgtttgcaatcgtgacagcactgctttgcatgcttgcattattaggcttataaatcgcattggaaaattgcaaaatgacctgcccgaacggagcaggagattggaaggataagacgatgaatttagaaggaaaaagagtgttagtagtaggttctggaaaaagcggagttgcagccgcagaactgctcagaaaaaaaggaatcacatttgtactttttgatggaaataaagatttagatgtgacagcattgatcgagaaaaatccggtatttgccggagcagagattcttttgggagaacttgcaccggaagatatggcgcgcattgatcttgttgtgttaagtccgggcgtgccgacagaccttccgatggtcaatgaacttcgaaacagacagattccaatctggggcgaaattgaacttgcctatcattttgcaaaaggaagaattattgcaattaccggaacaaacggaaaaactacgacaacttcgcttgtgggtgagatcatggcgaattatttcgatgatgtgaaagtggtcggcaatattgggatcccatacacatcggtagcggcaaacacgacagaggatactgtgacagtcgcagagatcagcagcttccagttagagacaacacatgagtttgcgccggaagtgacagctattttaaatatcacaccggatcatctgaaccgtcatcatacgatggaatgttatatcgagacaaaagagagcattacaaagaatcagaccgccggggatacctgtgtgttgaattatgaggatgaagtgctgcgcaggtttggcgagacacttcagataaaagttgtatttttcagcagcaagcgcagactggaaaagggactttatctggacggagaatatattttttatgcagacggcacaacggacacaaaagtgatcaatgtaaatgagctgaatattttaggaaaacacaattatgagaatgtcatggcggcagtcggaatgtcggtaagctttggcgtaccgatggataaaattgtggaagtgctgaaacgtttccaggcagtcgagcatagaattgagtatgtgacagaaaaacgcggcgtgaagttttacaatgattccaagggaacaaacccggatgcggcaatccagggaatccgcgcgatgaaccgtccgacactgttgatcggtggaggttatgacaaacagtctgaatatgatgagtggattgagagttttgacggcaaggtgaagaaactcgtgctgatcggtcagacgaaggaaaagattgcggaatgtgcgaagaaacatagctttgaggatgtcatactctgtgatacatttgaggaggcaattgacacctgttatgcaaacgcagtgagcggggatgcggtattgctttcacctgcatgtgcaagctggggcatgttcgcaaactatgaggagcgcggacgcatttttaaggaatacgtgcgcaatctggcagaataaaaaatgtcaggcataatggcatgacgtgcagtaaataagaaatgaggaattggaatggcaagaggtcagcagacggaaaagaaaaaaaagccaattaaatatttcgattacagtcttttgtttctgatcatttttcttttgtgttttggattggtcatgttgtacagtaccagttcctatgcaggttccaataagtttggggatgcttcctattttgtaaaaagacagttgtttgcaacaggactggggatcgtgggtatgtatatcgtatctaagatcccatatcggttctggatgaaggtgagttccatggcgtatctggcagctatcgtgctctgtaccgccgttatttttattggtacagaggcaaacggtcaggcgagatggttaaaaatcgggccgttatctttccagccgtcagagtttgccaagtttgcggttattatttttctggcaacggttatttataagacaccacagaagatgggtgaattcatgagccttgtcaagataatggcaattgtgcttccaatcgttgcagtggtcgcctacaataacttaagtacagcgatcattatacttggaattgcagtctgtatgttgtttgttgccagtccgaagtattcccactttgtgttgatggcagcggcagtcggtgtggtaggtgttgttttcatcagttttgaggcataccggatggatcgtatcaagatctggctgaatccggaagcctacgagaagggttatcagaccttacagggactgtatgcgatcggttccggcggtttatttggaaaagggcttggcgagagtatgcagaagctgggatttattcctgaggcgcagaatgatatgattttctctgttatctgtgaggaacttggactttttggcgcggtgtgcgtgatcttattgtttctgctgatgatctggagatttatgatcattgccaataatgcgtcagacctttatggggcgctggtcgtggttggtattatggcgcatttgtccatccaggttattttaaatattgcggttgtgaccaatacgatcccaaataccggtatttcactgccgtttatcagttatggaggtacttcggttttattcctgcttgcagagatggggcttgcgctttccgtggcaaagggaattaaatttgaggttaattaaatatgataaaagaagagagaagaagaaaaaagcgcagaaagataggattgtacatcctgttgatattgattctgcttatcgcagcgggcgttttcactgtcatgaatgtttttaccgtggaaaacgttgtcgtggagggaaatgaactgtacagctccacacagattgaaaacatggtgctgaatgatgaatattcctggaattccctgtatgtagatttgaaatacagatttgtggatatcggggaagttccgtttgtagatacgatggaggtttcactggacaatccccataccgtacatattaaagtttacgaaaaaggaatgctcggctatctttatattaattccattggtcagaatgcttattttgacaaagatggatttgtagtcgagacatctacggaagtgattgacggtgtgccaaagatcacaggaatctcctgtgaggaggtggtactttatgagaaactgcaattagagaacagtgatattttgcgggatttactgaacctgacacagactttgaaaaaatataatctgctcccggatgagatccagtatgacagtaacatggagccggtgctttactatggaacaattcaggtgaaaattggttctgaggacaacctgtcgcagaaagttgtgaggttatccattattttgccacagcttgacggacttagcggcacactccatttagagacatggacaccggagaccaccgacattatctgggacagggcagaagaacaatcggaaacagaagaggagacgacagaagagccttctgaggagccgtcggcagatacaccagcggaagaacaacctgcacaggatgtgccggcagagaatacaccggccgaagagcagcagccagccgaaaatgcaccggcggaggatatgccgccagtggaacaataaaaaccgtaaaaaaacttgattttttttgaaaaagcggttgatttgttgtaggaaaaattatattatagtttataagagttaaaaaacgcaaaatatagtatgatttcgagagtagataactaaacaaagtagaaatgggcttgtctggttatcatatttgacataaatatagggagatatgaaggaggaactaccttgctggaaattagaacaacagaagcagatgccagtgcaaaaattatcgtgatcggagttggaggagctggtaataatgctgtaaatagaatgatcgatgaaaatattggcggtgttgagtttattggtattaacacagataagcaggcattacagttatgtaaggcaccgacattgatccagatcggtgagaagcttaccaaaggacttggtgcaggagcacagcctgaggttggacagaaagcagcggaagagagcgcagaggagttatcagctgcagtgaaaggtgcagacatggttttcgttacctgtggtatgggtggtggaaccggtacaggtgccgcaccagtcgttgccaagattgcaaaagagcagggaatcttaacggtaggtgttgtgacaaaacctttcaaatttgaagcaaaacagcgtatgttgaacgcaaccggtggtattgaacgtttaaaagagagcgtagatacactgattgtcattccaaatgataaattattagagatcgtagacagacgtactacaatgccggatgcattgaagaaggcagatgaagtattacagcaggcagtacagggaatcacagaccttatcaatttacctgcactcattaaccttgactttgcggatgtttccaccgttatgaaggacaagggacttgcacatatcggtattggttctgccaagggagacgacaaggcaatcgaagctgtaaaacttgcagttgccagcccattgcttgagacaactattaacggtgcaacacacgttattattaatatttccggagatatctccttgatggatgcaaatgatgcagcaagctatgtacaggatcttgcaggagatgatgccaatattatcttcggtgcgaagtttgatgagtctatgacagatgaggcaaccattacggttattgcaacaggacttgagactgccggtgcaaacgcagcaggcaaaattgttcctaagatgcagtatcagaacatgggaactgttccaagaccgacagcacctgtaacaccaagaccagcagcacaggctggttatacagctccggtacagccaaacccggcaccaactttctctggtattcagaaaccgcgccagccagaaagctctgtacagcagatggatatcaagattccggatttccttaagaattccagaagataattacataagaagatgacaggatcgttacatgaagatcataaggttttcatgtaacggtctttttttgtcagaaaaactggatgaacttctgaaagtagagggagtgttttgacaaaaaagatggttctaaaaaaatataatgtgactatggagaaggaaaaggagggagtggttccaaatatatattttttatgcagatgtctatctgttacagaatctgtggatggattttattgcgcttgcgggcgcaaattgtcttttgcggcgcagggtaaagggaagaagactgtggtttattgcatttctgtcatccataggaactctgatcattacattgacagttacggagcctttttgcagggcgattctgattcacttcctgctcaatacaggaatggttgttctgtgttttggaaaaagttcgtggcgtgagtttttagaaaactgggcagtcatttatctgatggtcattttccttggcggggttatggaattattgagaagcagtgcaacaggaatgacatttttctggattcaggcggtcattgcggcactggttctgtcggttgtcacatggtatctgggacgtagaaaacagtttggaaatcagctttttccagtgacattggtgcatcgggggcatgcgatggaaactatgggatactgggacagtggaaaccagctgcgcgatccgtacaatcacagaccagtatgtattttaagtaaaaaagtggccgcaaagatcttaaatccgaaaaaggacagggtacattttatcccttattgttccctggggcagaaggaggggcttttgccggtgacagagatcacatgcataaaaattcagaatggaaggcacgaagtcgagataagaccggcaacggttggaattgcaaatgaaggattattggaaggaaaagaatatgatatgattcttcatgcatctatgctggagtgtcaggaaagaggaacaaaacatgatcatgagacttgtactgccaagatatgaaaaggttcattttctgtccgggatttgcagcctttttttgcgaaaggaagatgaggtgcactatattggaggtgcagagattttgccgccaccgttggagggagagcgggaagcatactgtatccggatgctcgatggtgtgcatgcagagcgggcgagaaaggagctgatcgaacacaacctgcggctggttgtatacatagcaaaaaagtttgataacacaggggtcggagtggaggatcttatctccataggaacgatcggtctcatcaaagggatcaatacctttaatccggacaaaaatattaaattggccacttacgcatcgcgctgcattgaaaatgagattttaatgtatctgaggagaaacagcaagacaaaactggaggtgtccatcgatgaaccgttaaatgtggactgggatggaaatgaactgctcttatcggatattctggggacggatgaggatgtcgtggggaaagacatggaaacggatgtagagcggaaactgttaaagactgcgatcgaaaagctgtccggaagggaacggatgatcatcgaactgaggttcggactgaatacttctgatggggaggagaagacacagaaagaggtggcagatatgcttggaatctcccagtcctatatctcaagacttgagaaaaaaattatgggaagattgaaaaaagaaattgtacgatttgaataacaggagtataattgtgttataaattaaaggagaagtcgaactatttgacaatgggaacagacagtggacagatgagacaacatgcagcagatgactgcatggggatcagatgaaaacggactggaatttacagacagggggaaggacagatgcagatagaatttttgggtgcagcgcatgaggtgacaggaagctgtcattatgtaacattcggggataaacatgtactggtggattgtggtatggagcagggaccggatctgtatgtgaatcaggagattccggtgaatgcagcagcggtggattatgtgttcgtgacacacgcacatattgatcattccggtctgcttccgcttttgtataatcacggatttcgcggacagattttcgcgacagaggcaacaacgcagctctgtaatatcatgttaaaagacagcgcacatatccagatgtttgaggcagaatggagaaaccggaaagcaaaacgggccggaaaaccggaagtggtaccaatgtacgatatgaatgacgcaatgggggtgctgacacactttgtgccgtgtgaatataacagcattgtggagatctgtgacggattaaaggtacgctttgtggatgcaggacatctgctcggctcatcaagcattgagatgtggatcagagaggatgatgaagaagtcaaagttgtattttcgggggatatcggaaatggtaatcgtccactgatcaaagatccacagtatatcaaagacgcggattatgttgtaatggagtccacgtacggtgacaaagagcatgagacaccgccggactatgcagtcgcacttgcaggggtattgaaggatacctttacaagaggtggaaatcttgtgatccctgcattttccgtaggaagaacgcaggagatgctttactttatccgaaggatcaagacggaacatctgttgccggagtttgaaaatttcccggtgtttgtcgatagtccgctggcagtggaggcaactacgatctttaataagaacgtggaggactgtttcagcgaggaagcgttggatcttgtgcatcagggaattaacccaatcggttttccaggactgcgcatggcgatcacgagtgatgaatccaagatgatcaatttcgacgagcagccgaaagttattatttccgcatccggtatgtgtgaggcaggacgtatccgtcaccatttaaaacacaacctctggcgaaaggattccacgattttatttgttggttatcaggttcccggaacacttggaaattctcttttaaatggggcaaagcaggtaaagctttttggtgagaccatcgaggtacatgcgaagattgagaatcttccgggaatcagcggtcacgcagaccggaataatctgacaaagtggattggggcatttgagacaccaccgaaaaaagtgtttattgtacatggggacgacaaagtgacggagaattttgcggcgcatgtgcatgaagtatatgggtatgacacgtatgcaccatatagcggcgatacgtttgatcttgtgacgggagagcagattgcggacggaagcagagagatgattgagaagaagaaaaatggatcatcaaaagcttccagcaacgtatttgcaagacttcttgcggcaggacagaggctgcttgaggttattaataagtgcgagggtctgccgaacaaggaacttgcaaaatttgcagatcagattaacgcattatgtgataaatggtcgagataatgttatacggtaagatattggcggatggttttcaatgcagacttttccagacggctgacctgtgcctgggaaatatggatctcatccgccacttccatctgtgtttttccttcaaaaaagcggaggttgataataaagttttcacgctctgacagacggttcatggcatcactcagtgagagtttttccacccagttttcttctttatttttcttgtcactgatctgatccatgacataaagggtatcgcccccatcggtgtagaccggatcatagaggctgaccggactctggatcgcatccagtgcgtacaaaatgtcttctgcggcaactccggattctgctgcgatctcctgcagggtaggttccttaaatgaattcctggacagaacttccttggcatggatcgctttgtaggcagtgtcgcggagggagcggctcacacggatactgttgttgtcacgcagatatctgcggatctccccgatgatcataggtaccgcataagtggaaaattttacctgtagatcaggattaaagttgtcaatggatttgatcagtccgatacagccgatctggaacagatcatcaagattttcatggctgccggagaaacgcttgatcacacttaacacaaggcgcaggttgcctttgatatacatctctcttgcttcctgatcgccctgccggatccgtgcaaacagggcttctttttcggtttcttttaaaattgggagtttggcggtattgacgccacagatttctactttatatgcaggcatgttgctatcctccggtcttttctaaaatcaggatcagctccgaggtctgtcgatgtcggatgctattaatgaggatgtggcatttaagaaaaaattatacagaaagaaacttttttttattggaaaaaaatgctatactatacacggtaagaaaatcgtttcagtagagacggattgttttaaaaaagcataatcaaatgggatacgaagaatacaacaagaggctggtgcatatatgaaagatttgatcgatgagaagaacagacaggaaaaaatgaaaagaagtatcataaaatactggaatgtttcctatggttccccggaagcaattggtggcgaagaggaagaaaaagagcgggaacatgccgccggcatatatccacaggaaaatcatgtctatgacgaagagtcagagttaaaacaggcagagatcgaggcgatcgatgaagtgtcacagacaaaaatccaacagatcctgcatgagaaagatgacagattacagaacctgatcgaacatgagcagcatgagggataggaatcctgaagctgttttggcagggttgcgggcagatgcacattttgtagtctgccacataatgtaatagtaagaacaggcgatggtgggatcgttttggttacattaaaaaagtatcacggtcttgggaatgattatctgatctatgatccgaatcagaaccgtgaattattacaggaacggcagatacagctgttgtgcaggcgcaataccggagtgggagcagacggtattttatctgggcctgtgttggagaatgaaaaaataaaagtacgtatttttaatccggatggaagtgaagctgagagaagcggcaacggcatccggattttttcaaagtatctgaaagatgccggatatgtgaaagagaagtgttatgagctctggacaaaggcaggaccggtacaggtggagtttttagacgaggatgcatcgcatatgaaagtcgatatgggatacgccgcatttggggcagacagtatccatgcggtaggatttgagggagatatgatcaacgaatccgttttcttctgtgataatttttacaatatcacctgtgtgtctatgggaaatccgaactgtgtcgtgatgatggaagagatcagcaggaagaaagcgctgcatttgggaccatatgtggaaaattcaaaatattttccagaccggatcaatatgcagctctgtcatgtagttgaccgggaaaatatccagattgaaatctatgagcggggagccgggtacacatatgcgtccggtacaggagcctgcgcagcggcatctgcggcacataaactcggactggtgggaaactgtgtgcaggttcatatgcagggcggagatctgctggtggaatttgcagaggacgaccgcgtgtttatgacaggacctgttgtttacattggaagtatcacgctggcggaaaatttttttgcttaaattggaaaatttcttggtgttatgaataccgcacagcagcagggaatatgggaacatatggaaaccattataaaaaagtcttgcaattgcaggcagaatatgatagtttataaatcgttgtgtgaggaacacaacgattttttcatgcagaggtacaattctgcaaaaacaaacgtcagttcggaaccttcctgacgaaaaacaaaactaaaggagaaaaacatatgagaaacaaaaaggtattatttcttacccaggctgcagtgatcgcagcgatctacgttgtgctgactatttttatcagtgcatttaacttagcttccggtgccattcaggtacgaatttccgaagcacttaccattttaccattttttacaccggcagcgattccgggactggcgatcgggtgtctgttgagcaatctgctgacaggggcagcggtttatgatgtcgtgttcggaagccttgcaacattactcggtgcagtcggaacatatttactgcggaaacataagtttttgtgcacgcttcctccggtgatcgcaaatatggtgatcattccatttgtattgcgttatggatacggacttgcgatggaagttggtggacatgatgtcgcaattcctttttacatgctgaccgtcggcgcgggagaagtgatctgctgctgtattcttggctctatcttattgaatgcattggcaaaaatgagaaatgttatttttaagaatgaataaatgtgaaggttataaaaatgccatgtcaaagagataaaactctctttctcatggcattttaataatttttaagaaaatattgacgatttctgaaaacgcaagtaaactatatagttagcagtatctataagagagaacgaaaggaaaaagttatgaagaaaatcttggatttgatcacagatgaagtgacaaaagcatttacagaatgcggatatgatgcaaaatatgcaaaggttactttatcgaacagacctgatctttgtgaatatcagtgtaacggcgccatggcagccgccaaggaatacaaaaaagccccatttatgattgcagacgaagtagtggaaaaacttgccgtaaacccgatgtttgcgatggcagaatctgtaaaaccgggcttcctcaatctgaagatcgatgaggcataccttgcagattatgttgcaaaaatgcaggaagatgagggacgttttggatgtgaaaagacagaagcgccaaagaccatcatgatcgactatggcggaccaaacgttgcaaaacctctccatgtaggacatctgcgttctgcgatcattggtgagagtgtgaagcgtatcggcaaatttatgggacacaatgtgatcggtgatgtgcatctgggtgactggggacttcagatgggactgatcatcacagagttaaagcaaagaagaccggaactggtttattttgatgacacatacaccggagagtatccggaggaggcaccatttacaatctctgagttagaggagatttatccgactgccagcaagaaatccaaagaggatgagacgtataaggaagccgccatgcaggcaacttttgaactgcagcatggaaaacgcggttatcaggcacttttaaaacatattttaaatgtgtccgtgacagacttaaagagaaactatgcaaacttgaatgtttcctttgagttgtggaagggcgagtctgacgcacagccatatattccggatatggtacagaagatgaaggacgatggctttgcctatatcagcgacggtgctcttgtcgtggatgtcaaagaggataccgacacgaaagagatccctccatgcatgatcttgaaatcagacggagcttctctttataatacgacagatcttgccacgatggtatggagaatgaaagattacaatccggatgaacttatttatgttgtggataaacgtcaggaattgtatttcacacaggtattccgctgcgcgagaaaaacaggtattgtaaaaccggaaacagaactgaagtttttaggttttggtacgatgaatggcaaggacggaagaccatttaagacccgtgatggcggtgtgatgcgtttagagcatctgatctccggtattaatgaggagatgcttgcaaagatccaggagaaccagaagacaaaggagaaccttgggatcagcacagaggaagcggagaacactgcaaaaatggtcgcacttgcagcaatcaaatacggtgatctgagcaatcaggcaagcaaagattacatctttgatattgaccgctttacttcttttgagggaaatacaggcccatacatcctgtatacgatcgtccgtatcaaatcgatcttaaacaaatatcacggtcttggaaaagatgacagcggtgcagtcatcggggcggcgcactctaagagcgagaaagatttaatgttagaactctccaagttcaatgcagtgatggagagcgcttttgaggagacagcacctcataagatctgttcctatatttatgacctcgccaatgcattcaacagtttctatcatggaaccaagatcatgtccgaggagaatgagacagtccagaaatcgtacatccgtctgttagagcttacaaagtccgttcttgagacctgtatcgatgtattaggattttctgcaccggagagaatgtaagaaaagaatagaataacagtcataaaaagaaagacaagtcatagaattagtcatgggagaaaacaaactcccatggctttttttctttaaaaaaagaattccgtgaggatggaacagaaagtgaggtgccgccttgtgtgaaataagattgttgtttccggtacatatgagaacattttttcaggacgatacatggcagagcgggttggaggagatccgggtgagagtcggacaaccaatcgagttttgctatggaagcgacaactgttatctgaccggtaaagaaaaagaacaaatgttctgcagcgaaaaggactacagaagatgggaaaaagatctgtaccatgcgaccgaggcagatctgcgggaaatgttgaattatatcagcaattattcgctgtacgcctacaaagaggagattaagcaggggtacatcacgatcgagggaggacaccgggttggcgtggcagggcagaccgttctggtggatggaaaaattgcagggatcagtccgatcatgttcttaaatatcaggatcgcccatgaaaagtgtggatgtgccagaaaaatactgccgctgatccggcagagagacagcatttataacacgttgatcctgtcaatgccgggagccggaaaaacaacacttttgcgggattccatccgtgcgttgtcgaatggggaggcatatgggatcaggctgaaggtgtgtgtggtggatgaacgctcggagattgcggcaagttttcacggtgtgccacagaatgacatgggaccgagaaccgatgtgatggacggctgtggaaaggcagagggaatgcagcttctgatccgttccatgtcaccgcagatcattgcggtggatgaacttggagccgagtcagatttttatgcggtagagcaggcattaaactgtgggagcagagtgcttggcacgatccatgcagggaatatgaaagaactgtcggaaaaaccgtatctgaaacggtggatggagcgaagactttttcagcggttcatttttctggaaaaagagaccaacgggaggagaaaaatgcaggtttatgacgagcatatggagcggatcacatgttaaaagtgctgggaagtatgttgattcttctggcaagcgttggttttggatttcaaatccaaatggatctgagaaatcatctgcggctgctttatgacatacggaaactgctcttagacattgcaaatgaaacagcgtatacgatggatcccatggaggtagtgctggaacatgcgatacatagcagaaacccgtatctgaatgagatctgcaaggagatgggtgagggattacagaagaaggaaagaggatgcggacaggaactctggcaggagcggatcgaagcgtggcagaaaaggctggggctctctttggaggaaaaagaaatctttgcaggggcaggatgcgcctttttcggaaaaagcatgggagaaaatgaaaaaagcctcgaacattatctggaacgtctggattatgtgatcgatcaggtgaggggagaacaaaaggaaaaacagaaagtgtatcagaccgtcagtgtgatgtgtgggctgatcatcattcttctgtttttgtaaaagctccgaaagctgtggaaaggcaggaactttatgagtgtaaatttgatttttaaaattgctgcggttgggattttagtgaccgtgttgagtcaggtgttaaaacacagcggacgggaagaacatgcttttttgaccagtctggcgggacttatcatcgtgctgttctggatcgtgccttatatctacgaactgtttgagacgatgcagtcgctttttacgttataaatcatagggcagttacagtctgctggggagtgaaaaaggcatggatatcataaaagtggggattttaggtgtcgcagcggttttgatggcaattccgctgcgcaaagagaagcaggaatacagtatgtttttaagcatggcagtctgtatctgcatttttatttatattatcacaaaggttcagatcgtgttggaatttgtggagaagttagaggggatgatcgccattgacagtacttatattggtctggtgatcaaaatggtgggcattacctacgcggcagaattttcagtaaatgtgtgcagagactccggttatggtgcgattgcaggacagattgaaaattttgcaaaaatgtcgatccttgtggtgagtctcccggtactgatggcatttattgatacgatagggagccttttatgagaaaagtgggatggcagtggaagatcatactgtttctgatgttcgcagggctcttttgtccggtgaaggttcatgcggaagagacaggtagttatctgagtgaactttcggatgagatggactatggaaaattggatacatttttaaaagactatggcgtggagcaggtttctttttccggtctggtggaagaactgatgcaggatggggtaagcacagcgtggggagaacatgtgttttctgcgataaaaacatcgctcgttggggagatagcagctaaccggaagatgcttttggaaattgtactgctggcgttctgtttttcggttctgaaaaactttgcgggtgcatttcatgcgtcgtatatctcggagctatgttttctgctggtgtattgtgtcatggcagtcatgcttttgcagacatttcttctctttcaggaggtcgtgtcaaagtcattggaaagctgtgtggaatttatgaaagtcatggtgccgacgttttgtctcagcatgatgtttgcctcaaatgtgagcagtgctgcgggattttaccagaccgcatttctggtgatctatctggtggagtggctgtttttaaatctgctgatgcccctgatccatatttatgtgctgttggaaatgttcggtcattttgtgccggaggagcgcttttcaaatctgacagaactgttttctgaggtgatcaactgggggataaaaatcgcaggagtgctcgtattggggctgaatgtagtacagaacctgattggcccggcaaaagaccggatggggcatgggatttttgcaaaaacggcttctgtgatcccggggcttggaaatgcggtgggcagcgtgaccgagctgctccttggcgcagggattgtcatgaaaagctgtgtggggacagcgggacttgtggtgcttgtcctgatcagtcttgttcccctgctcaaggcgctgtgccttgcattcttttacaaactggcagcggcagtgactgagcccgtgtcggataagcggatctccggctgcttaaaaggtctggcaaacggaggtatgctctatgtaaaactgctggggtacagtgtgctgttgttttttgtgacgatcgcactgacggcggcagcgtcgggatttatttattgaagataatgggaaggagccgatgaacgggatttttagttatctgaaaagctatgtcattctttttcttgtgctcacgatactgcttgagatggttccgaaggcgggcatgcagaaatatatccgttttttttcgcagatgatcctggtctttggactgctctatccggttttggggtggatgggagagagtgacgcttttctggaaaaaatagaatatcagtcttttttacagaaaatggaggaggtccagtcagatgcagaaaaaatcacctatctggacaatgatcactatgtgaaaaagtacgaggatgccattgcacttgatgttacacagatggcacaggaagaaaattttgcagtgaaggagatcgcagtagagatgacagaaaattatgaaatcaaatgtatccgcatgacactgaccaatccggtcagggaaggaatcgtgattggaaaagttgtgctggaggatgaacagaaaaaacagacttctgaggatagcgcatataaaaaattaaaagaaaagctggtgagttattatcaattatcggaagaacagttggatatcctgtatgaatagactgcggcagctcaaaaaaagtgactggatcgccattgcacttgcgggtgtgctgattctgatcattgcaatgccgttatcgccgaagcagtcagagagtgggaatacggcggggcaggagacagccggggcagtttcggattccgggagcacacagggcagccagaatgcttatgcggctgcgctggaaaggagattaaagcaggtacttgggcagatggagggggtaggagagacagaggtgatgatcacactgtcagattccggtgaaacgatcgtggaaaaagatcagaaagaacagagaaaccgtatcgaggaaagtgatgcaggtggaggaacccgtacaacgacggagcaggagacggaggagacaacggtgtatgtggaaaacggcagtgaaaagcagccttatgtgacaaaagaagtgcttcccaaagtagagggcgttctggtggtggcagagggcggggatgatcccagggtgatttctgatatttccgatacagtaatggcattattccgggtggaagcacataaaataaaagtagtgaagatgagtagttccagagggtaaataaggaggaatcacatgaagaaaatatttcgaaaaaatcagctggtgatcacggcactggcgcttatgatcgctgttgcagggtatttcagttacatgaataacaatatggatgacggaaaacttcagacagcggcggaggcggcaaacgcagaggtgagtgcaggggaactggaagaggattacgacatttcggatgaagatgttttgcagaatgagatttttacggcggaggaaccggacgggacggagacagcggcagtaacggatggaagcgcagagacagcggcgggcacggagggagaacctgcagcggaaggaacagggcagacagtggcagatggaacagcaggggcagaggaagtcgtcaatccgggagaggcggtgctcaccagtacgaccgttgccaatatcgactatgcttcggaaatgaaattaaaccgtgaacagatccgctcaaaaaacaaggagacattgttggagatcgtaaataataatgcgatttccgatgagttaaaacaggatgcgatcaataaaatgatcgcaatgacggatatcgcagagcgcgaaaatgcggcagaaatgcttttggaggcaaaaggattcacagatgtggtggtaagcatcaccgaggacagctgtgatgttgtcttaaatatgggagaagtgacggatgcaaagcgcgcacaggtggaggatattgtgaaacgcaaaacaaatgtttccgcggaaaatgtgatcattacgccaattgtagtaggcgaggtggacacggaataatatcagattttccttgattttctttggctatcgttatatccttataaggcggcagtctgcaaagcaggctgtgcggtgttacaatgagacatgacagcggtctcttgggactttatttacacattacaggttctttttgagaaccgctgtgctttttatatttggaggatatattttggctgatttaagaaaagaaatagaaaaaagacgtacctttgcgatcatttcccacccggatgcaggtaagacgacattgacagagaagttcctgctttacggaggagcgatcaatctggcaggatctgtaaagggaaaggcaactgcccgtcacgctgtttctgactggatggagatcgagaaggagagaggtatctctgtcacttcttctgtattacagtttaattatggcggttactgtatcaatattctggatacgccgggacatcaggatttctcggaggatacctaccgtactctgatggcagcagattccgccgtcatggtcattgacggatcaaagggtgttgaggcgcagacaagaaaactgtttaaggtctgtgtgatgcgccatatccctatttttacgtttatcaacaaaatggaccgcgatgcgaacgacacgtttgatctgttggatgagatcgaaaaagagcttggaatcgcaacctgcccgatcaactggccgatcggttccggaaaaggatttaaaggtgtttatgaccgcaatacaaaagaggttatgacgttctctgatacgttaaaaggaacaaaagagggaacggagagacacattcacattgatgatccggcgcttgtagatgaaatcggtgaggcagcaaaagaaaagctgttagaggaaatcgagctgcttgacggagcaagtgcagagtttgatatggatctggtgtcaaaaggtgagttgtcccctgtattttttggttccgcgttaacaaactttggtgtggagacatttttacagcactttttgaaaatgacgtactctccgcttccgagaaaagcagatatcggggagatcgatccgtttcaggaagatttctctgcgtttgtgtttaagattcaggcgaatatgaacaaagcgcaccgtgaccgtatcgcgtttatgcgtatctgttccggaaaatttgaggcgggcatggaagttacccacgtacagggtggcaataaaaagatcaagctttcccagccacagcagatgatggcgcaggagcgccacatcgtggatgaggcttatgccggagatattatcggtgtgttcgatccgggtattttctccatcggtgataccctgacaacagcaaaaccttttaagtttgagggaatcccgacttttgcgccggagcattttgcgcgagtgcgtcaggtggataccatgaagcgtaaacagttcatgaagggaatgcagcagatcgcacaggaaggtgcaatccagattttccaggaatataacatgggtatggaggaagtcatcgtcggcgttgtcggtgtgcttcagtttgacgttttaaaatatcgtctggagaatgaatataacgttgagatccgtatggacaaccttccgtatgagcatatccgttggattgaaaatgaggatatcaatatggataagatcgttggaacctccgacatgaagaagatccaggatctcaagggacgtccattattactgtttgtcaattcatggagtgtcggcatggtacttgaccgaaatgaaggacttgtattgtcagagttcggacgggagtagattcactgttatcagatagttgcgaaactcttcataatcttctttaaattgttcaaaattaacaaaaacattcaagacacgctctcgctacgtgtcgctcgcagcggtactaagaagccaggcacaacttaccgttgtaccagccttctaagtaccaatcgaacttgttcgattttggctcacccagtgtctttcatgtcttttgtcaatttttcacaattcaatttaggtttttatgagtttcgaattgtctgataactattaaaaaaaaggagagaaagatggcagttgtaacgattacaaaggataattttgaggcagaagtattgggatgtaagatcccggttgtgcttgacttctgggcagaatggtgtgaaccatgcaaaatgcagtctacggttatagaagagcttgccgcagagttggatggaaaagtaaaattcggtaaggtgaatgtggacgaagaggcttctctggcactgaattatcagatcatgagtatcccgacattggttgtgatgcattatggtctgtttcagggaaaagcaatcggcgtgcagggcaaagatgcgatccgtgaaatgcttcagggtgttttgtaaaacaccttgacaaatttctatctatcagttacagtcaatcttgcagatagcagaatctttttttatcaaataaaatgttacaagagtaattatttcagccagatcggcatgaaatcccggcaaaaaatagaaagtgatggtttaaatagggggaaaactatcttaaaaggatgaacagggacagaattgtttcatgttcgtagttgacatttagggcaaagtataatactataagaacaagaaaacgaacataagttcgtgttggaggaaagaaaatggcaagagaagataaattgaaagcgttagatgctgcaatttcacagattgagaaacagtatggtaagggatctattatgaagctgggtgataattcagcacatatgaatgttgagacaattccaactggatctttgagtcttgatattgcacttggtcttggaggacttccaaagggaagaattattgagatctatggtccggaatccagtggtaagacaacggttgccctgcatgcggttgccgaggtacagaaaaggggcggaatcgcaggatttattgatgcggagcatgcacttgatccggcttatgccaagaatatcggtgtgaatattgatgagttgtatatttcacagccggactgtggagagcaggcgcttgagatcacagagacgatggttcgctccggagcagtggatatcgtgattgttgactctgttgcagcacttgttccgaaagcagagattgatggagatatgggagattcccatgtgggacttcaggcaagacttatgagccaggctctccgtaaattaactgcagtcatcagcaagtcgaactgtattgttatttttattaaccagctgcgtgaaaaagttggtgtgatgttcggtaatccagaaacaacaaccggcggacgtgcattgaaattctactcatctgtgcgtatggatgtccgtagaattgaatctctgaaacaggcaggagaggttgtcggtaaccgtacccgtgtgaagatcgtaaagaataaagtggcacctccattcaaagaggctgagtttgacattatgtttggtaagggaatttccaaagagggagatattttagaccttgctgcagactgtggcattattgtgaagtccggtgcatggtatgcctataacggagataagattggtcagggacgtgagaatgcgaaaacttatctgagagagaatccactcgtatgtgaagaggttgaggcaaaagtcagagaaaaattccagttagatggtactgcagaagagacggatgctgagggagagccagaagtattagaggatgaggaataaaaatgagtcttcaggtcatgtcggtcgtacctcttgagaagggaaaagcaagaatccggtttgatgatgggacagaagttgttctttataaaggagagattcgaaagcttgggatagaggagggctgtgttgtcacagaggctgtctatgataagattctgaatgaaatccttggaaagcgtgcaatcaagagggcaatgcatctgttggaaaagcaggaccggacagagcgtcagctttatgacaaactgaaacagaacggatatccggaaagttgtattgaatccgcaattgcctatgtaaaaagttatcattatatcgacgattttcgttatgcttctacctacatccgttatcatcaggagaagaaaagtagacaaaaacttaagatggaactgatggcaaaagggattggaagagatctggttgatgcagcattagaagaagagtatgtttcggatgatcagaagaagattgcagagttactgcagaagcggcattattcttttgaggatgcagatgtcagcgaacagcggaagaattatcagtttttactccgcaggggattcaaaagcagtgatatccttcatgtcatgaagcaggaacggcagtaggagcaggccggagagaaaaattttgtttcagagaaaatctgacaaatttgtacaatatgttgtattcttatttttgagtcattcaatattatgcatattgaacagtaattgacttgacataagtatgaaaatagaataaaattaacctgttgttaattatgacagaaaattaatctaattatatgttatatgtacaatgaaaatttcataaaggaggtgctcctgtgctgcagatagtgatcgctgttgttataacacttatcgttactgcggttctgacatactttatcacaactgcttaccacaagaacgtagcaaatgctaagattggtaatgcggaagatagagcacgtgagattatcgatgaagcggtaaagacagcagaaaccaaaaaacgtgaagcaatgctcgaagcaaaggaagagtccatcagagtcaaaaatgatctggacaaagaagtaaaagagcgcagagcagagattcagcgtagtgaacgcagagtcgtacagaaggaagaaaacttagacaagaagttggaatccatcgagagacgcgaagccggttttgctgcaaaagaagaagaaatcaacaagcagaaagctcagattgcaaagctcaatgaagagcgtttacaggaactggaaagaatctctggattaacctccgaacaagcaaaggaatatctcttaaaaaccgttgaagaagatgttaaacttgataccgcaaaattaatcaaagaaatggaaaacaaggcaaaggaagaagctgataagaaggccaaagattatgtggtaactgccattcagaaatgtgcagcagaccatgtggcagagacaacaatttctgttgtacagcttccgaatgacgagatgaaaggtagaatcatcggacgagagggacgtaatattcgtacgttagagacgatgacaggtgtggatttaattattgatgatacaccggaagcagttattttgtctggatttgatccaatcagaagagaagttgcccgcattgctttggaaaaattgattgtagatggacgtattcatccggctagaatcgaagaaatggtagaaaaggcacaaaaagaagttgaaacaatgatccgtgaggaaggtgaagcagcaacattagaagttggtgttcacggaattcatccggaactcgttcgcttactcggcagaatgaagttcaggacaagttacggacagaatgcattaaagcattctattgaagtagcacagctttccggattattggcagcggaaattggtgtagacgtaagaactgcgaaacgtgcaggtcttttacatgatattggtaaatctgtggatcatgatatggaaggatctcatattcagattggtgttgatttatgtagaaaatacaaagaatcaccaattatcatcaatgcagttgaggctcatcatggtgatgtagaacctgagtccctgattgcttgtatcgtacaggctgctgatacgatcagtgcggcaagacctggtgcaagaagagagacacttgatacttataccaacagattaaaacaattagaagatatttcaaacggatttaagggagtagaaaaatcatttgctattcaggcaggtagagagattcgaattatggtagttccagaacagatcagcgatgctgacatggtattattggcacgcaatattgcaaaacagattgagtctgaattggaataccctggacagattaaagtaaatgtgattcgcgagtcacgtgtaacggattttgcgaaatagcttgacaaagagagcataaaagaagatttgaagaggatggatcctgtttcgaatcttcttttttatatgaaaaagcgttcgattgttatagaataatcctagaaccagaagaggcaggaggaaagaaagatgagtgaacatgcaaaaagaattaaacgggaattggtgatgaaaggcactattcttgatgtgtacaaagatacaatggaacttccaaatggcaaaacagaagaatgggattttgtctcacatagaaagggagctgcggcagttgttgcagtgcgtgaggatggaaaactgctaatggtgagacagtaccggaatgctttagagcgtatgacgttagagattcctgccggagcgagagacagtgtgacagaagataccaaagtgtgtgctgcaagggaactcgaagaggagaccggataccggagtgagaatctgtcatttttgctttcacttcgaacgacggttgcattttgtgatgaatttatcgatgtgtaccttgcaagagatttagtgaagagtacacagcatctggacgagggagaagcgatagacgtggaagcacatgatgtagacgaattgtgtgaaatgatctatgcaggtaaaatacaggattccaagacggtttctgcaatcctcgcctataagaatttgctgaataaggattccggaaaagcatagattattagtaagattgatttttggtagaaaattgtgattcaaaaaaataagatcatctatgcattatgtttccttgccggaatattgcttgtcaatcttatgggaagcggtttgttgaacacctatggtgtgacttccttctgggatcagtcagctgtcactttctggagcatgtcctatgaccagtatttctggtatatttttttcatgcggatgaaaggactgattgtgattctgctgcttggcacagtatttggcaggaggatcgtgacaagggtttttctggcactgtttctgttcctgacaggaatatttatcacaatgtcagtgatagaacggggactgtctggaatcgcagcagttttactggcaatgcttccgcagtggattttctatttactggcgttcaccgtgtatgagagaggaagagaaagaaaagtaatatttgtctgtgctttgctcgttgtgctggggtgtcttgcagaggggtatatttcaccgtttttcctgaaaaaagtactatgacagcgaaaatggggcagattatgtaatatgtatgtaaaaaaattgtaatgaataattacaacatatggtaagacagaaattacaaaaaacgacatgttgtatatggacaaaaagagacaaaaaaacaggcaaaaatactgattgcattttgatttctgaatcattataataggaaatatacctcgaaaatgaggtattttttcggcttgaaagagtttacattgagagaaaagaatcggggcaggtaatgagcatgaatcaggatatacataattttatccaatatcttcatcaggaaaaacaaacttcagagaatacagaagtatcttatgagcgagacttaaagaagatgattttgtatttaacagcacatggagtggatagaattgacgctgttaccccagaagttctgaattcttatgtgatagagttagaacagtcaggattaaagcctgcaacagtatccagaagtgttgcgtccatgaaagcattctttcactatgaagagttagaacaaaggacaagcgcagatccagcttttgaactgaaagctccaaaggtggagaagaaagccccaactattctgacaacagagcaaacaaaccgcctgttagcccagccgaaggataattcggcgaaaggtctgcgtgataaagcaatgcttgaattgttgtatgcaacaggaatccgtgtttctgaattgatctctttgaaattaacagatgtgaattttgataccgggtatattacatgtgtagattcacacaaggagcgtatgattccaatgactccggtggcaaaggacgcacttgtcagatatatcaaggatggacgtccacagttggtgaaggatgagaattccatctggttgtttaccaattgttccggggatgcgatgagccgtcagggattctggaagctgatcaagtcctatggaaagcgggcaggaatagagtccgagatcactccgcatatgctgcgacattcttttgctgcacatcttgtgtgcagcggggcagacttaaagagcgtgcaggagatattaggacattccgatatttcaacaacacagatgtatgcacatatgaatcagactgtaaatgtataaataggtaccgtgtagtctgcagatatacacataacataataataaatagagtgttcaggataaaatcctattgggatttatttgcatatcagtcgagcagatttcgtacatctttcagggaacagccctgtttgaaagcaattgcttttaaatcttcaaattccggtttttcatggtttacatgataaccggaatttttttttatgcggatttttccgtaaggagtttcttttgtctcaaacgtggagacgagtttcacacgttcgtaaacagcataacggatgccgcgggtggttgtgtgctgaaagaaaaggtttgtgaaattttctttttcagacagcggacagaggcaggtcaggataatccctggtctgccttttttcatctggatcgggatcgtatatacatcgagtgcgccggcgtttaaaagggtttccgcagcaaagcttatatcttcgcctgtcatatcatccagattgcaggagatacttaaaattttatcatcataaccgttcgcctgaacatcaccgagaaatgtccggacacagttggcggtttcaaagtctttttgtcccatgccgtagccgatatgttctaaagtcataacaggcatttcttcaaaaccttccacataatggcgaaggatagcggcaccggttggcgtcagaagttcgcccttgatggaaccggtataaaaagggattccttttaaaagctccgcggtcgcaggagctggaacagggaggataccgtgggcgcattttacaaaaccacttccgacatgaagcggggaagcgaatactttttccggtgtaatcagatacatgagaagagcacagccacagacatcagccagcgcatccaaagttccaacctcatgaaaatgaatctgttctaatgtggtgttgtgtacggcagattctgcttctccgatcaggcgatagatagcagcggcatctgcttttacctgggcaggaagctgtaagtgttcgatctgtgcgaggacagactggtaactgtgatgcgtgtgcgcatgggaagattcatcatgatgatgttccgctgcctcatgctcgttcgtgtgtacatgttctgcttctgtgtgatcatgggtatgtgtatgtacatgttcatgtacatgcacgccttcctcttctccgtttatcataacatgcatatgtgtgccggaaatgccgcacttttttgattcctccgcagaaatctgaatcccatattccgagaaagcctgattcatcgtctgcaaaaataattctttctggtcgcatatttcataaagggcagccatgagcatatctccggcagcacccatcttacattcaaaatataatgttttcatagataaaattcctttctgatagtaaaaacaaaggtcagaatccggttacctgttatgtaaaaagaggtaacggaatatgcctgacttattttattttaatcgacattttcatagtatgcaagcagggattcctgttggtacatttctacaaaaaatggaaactatttttgtgaaagtagtttcttgtgagaaaaactggaacatgttacaataatggaaacggaaatgtgaaaaatagtttccgaataaaaagcagagaaggggagcggatatggagttacgggagaccattttagagggaacgattcaggcatttaataaaaagggattgaagtttacgatggatgatatcgccgccctgcttggaatcagtaagaaaacgatttataccgtatttcaggataagaatacactggtgtcagagatggtggattactgttttgattccatcaaagagagcgagcagaaagtactctcggatacttcgcttgatacggttgggaagattcgggcaattttaggagtgctcccggagggttataaagacattgattttcggcagctatatttattgaaagataaatatccaaaaatttataaaaaagtggagcagcggttagagacaggctgggagacaacgatcgcgttgatccagcagggaattcatgagggcacggtccggccgattcagattccaattttgaaaaccatgatggaggcaacgcttgagcagtttttccagagagatattctgatcacaaatcagatttcctacaacgaggcgttagaggaagtagtcaatatactggtggatggaattacaaggtaaaagatagcatggagttcgttacacaggagaacagagagggtgaggatgatgtcagaacgtatttatttgaataatgactggaagtttgcagaacagtttgaagcttctatgacagaggcagcttatgatgacagtacaatgcagaatgtcaggcttccacatacctgtaaggaaacaccgcttcactattttgatgaacactgctatcagatgatcagcggttatcgaagagtcatcgaggcagagaaagcgtgggaaggaaaaaagatattactgacaatcgatggtgccgcccatgacagcgaagtatttttaaatggggagaaagtgggagaacatcactgtggatacacagcttttacgatggatatcagcggagtactccgctatggagaaaaaaatatccttgtcgtgaaagtagacagcagggaggacttgaatattccaccgtttggttatgtgatcgactatatgacatacggcggcatttaccgggatgtctatctggatatcaaaaatacagattacatcgaagatatttttatcaggacagacattggacaaatggatgaccagaatgcggaactcatttctgaggtgacggtgcaaagaacgcaggagggattgtttttaaaacagagtcttaaaaataaaaagacaggagagtatcagccattaggggagagtgaaatctcaggcacttccatgcagctttcctatccggtagaaaatgtgattctgtgggagctggaacatccggaactttatgaagttaagacagaattaatctgtgatggaaagttaatggatgagaggatagaccgaatcggattccgaagggcagaattcaaaaaagacggattctatatgaacggcaaaaaaataaaactgagaggtttaaaccgtcaccagagttatccgtatgtgggatatgcgatgccaaaatctatgcagcagctggatgcggatattttaaagagggagctgggggtgaatgcagtgcgcacctcccactatccacagtcccattattttatagagcggtgtgacgaaataggacttcttgttttcacagaaattccagggtggcagcatatcggtgatgctgcatggaaagatcaggcggtggaaaatgtcagggatatggtaaaacagtaccggaatcacacgtcgatcatcctctggggcgtgcgcattaatgaatcgcaggatgatgatgcattttacagaaggacgaatgcggcagcacatgagttcgatgattcgagaccgacaggtggtgtgcgtgcaaacagaaaaagcagtctgttggaagatgtgtatacctacaatgattttgtgcatgatggaaaagcaaagggatgtgagccgaaaaagaatgtgacatcggatatggaaaaaccatacctcatcagtgaatacaatgggcatatgtatccgacgaagacttttgactgggaagaacaccgggcagagcatgcgctccgccatgcaaatgttttggatgcggtggcagccgaggaggacattgcaggatgctttggctggtgcatgtttgattacaacactcacaaggatttcggaagtggtgaccgcatctgttatcacggagtcatggatatgttccgcaatccgaaactggcagcggcggtctatgcttgtcagcaggagaaagagccggtgctggaattaagttcttccatggatattggggaacatccgggatgtaaccgcggggaaacctatatttttacgaatgcggataaggtgcggatgtataaaaatgaccggttcattaaggagtacagtgccgcagattctccgtacacacatctgaaacacggtccgatccttatcgatgattttatcggagatgccctgcaggaagaacatatgaaaccgggacaggaagccggtgtgaaaaaagctttgaatgcgtttaccaggtttgggttcgcaaagcttccaaagtccatttatgcgacgggaatatggctgattcttcgctatcatatgaatatggaagaggcagttcggttgtataacaaatacattggcgactggggtggcacctccacaacgtatcgttttgaggcggtgatggtggatgtatctacaaggcaggagcgggtggtgaaaacaatcatcaaagaaccgatgatagagcggaagatttcagcagtggcggatcatgagaatctgatcgacgcagagagttatgatgtggctgaggttcggattcaggcacaggacgaacacggcaatatccttccgttttacaatgaaccacttacctttgagacagagggaccgattgaaatcatcggaccaaagacggtggctttgcagggaggaatgggcggcgcttatgtgaagagcaaaaggcttcagccaggagaaaagcaggatgcggtacttatcattcgggatggtgactcagatataaaaatcggttttacggttcgaagtgagagaaattaataaagtttggagagaatgaaaacatgacagacagatcaagtgtgatttttggaaataaaatgccggacaaggtttataaaaaggcagtgaagtccaaaaagaaatatatgaaaaaatttggagatgattccaaaaaaaattatgaggtggcggtcgagaagaaccgttacattggagattccctgggagtttacaatattctggtgggaaatctggcagagaatgcacattatgatgtcaatgcgcatgcggaaaaaggtacatttgacacagaaaaagggattattgtcggaaatatccgtatgggatttggacactaccgcatttccatggcgatggcgtctgcggcgaaggcgatgggctatacgccttactggatggacttaaattcctatggtgagacgacctgcacaaaagtgatcggtgcacagaatgatctgtattcactcggctcaaggctttcgaaaaatccaatcttcaacaaactggtctgggagccaatgaattatgagggattccgggcattgtcctacaatgcggcagaccagaaaaatgcggagctgatggctccggtgtaccgcaatgtgccgaaggatatcccggtgatcggaacacatgtctggccggcgcaggcagccgtacatgccggaatgaaatatgtggtgaacgcaatcccggataactggccgatggcactacatttgtcagaaggaagtgtgcatacgatccagtgtcataattcctatatgggataccgcattttaaatggcatgaataaagataaagtaaataaaccaatgccatccgacagccttgtatacacaggacattacattgaccatgaaattgtgcagggcatcgaagcggactgtgaggcgcgtatccggagaaaagagaatggtgagcctatgcgtttccttttaacgattggcggggctggtgcgcagaaggagatttttgcagcgatcatcaaattcctgtttccgtatattgagaagaagcaggcggcgttatacgtcaatgtgggcgattacagaaatgtctgggaggcgctgctggcagagattcctgagatgaaaaactatgcaacagaacattttgattgttgggcagatacagaagcatttgcacaaaaagcattggatgggaaggagaaaatcgaagggattcacggattctggcacaaaaatattttcgaggcggtatactgcacgaatcttctcatgagaagctgtgatgtcttagtgacaaaaccgagtgaactcgcattttatccggtgccgaaactgttcatccgccgcgtgggaaaacatgagatgtggggtgcgatccattctgcggaggtgggagacggaacgctagagtgccgggatattccgcacacgatccagatgctggaattatttttacaggacgatacttttctttcagatatgtgtcagaacattgtaacgaataaaaaggcaggtctttatgacggtgcttacaaagtcgtggaacttgcaatgggattaaaaaataaacagaaatgatgaatttttaatggagaaaaaggagatttttacgatggaagcaaagagaagtttgagcggcagagagaaatttgcctatggaatcggggcagtgggaaaggatatggtctacatgctttccgccagctacatttccatttattttctggatgttatgggaatcagcgcagcagcgatcgcagttcttttgatggcagcccgcgtgtttgatgcatttaacgacccgatcatgggtgtgctggtcgcaaagacaaaaacgagatggggaaaatttcgtccgtggctgcttgtcggtacggtcacaaatgcacttgtactttacctgatgttcacgatcccaccggaattaaacggtgcagggttagtggcatatgcgtctgttacctacattttgtggggcatgacttacacgatgatggatattccattctggagtatgattccggcatttaccgaggctggaaaagagagagagggattgtctgcatttgcacgttcctgcgcaggtgtcggttccgcactggtatcgatcgtcacggttatgagtgttgccgcacttggaaaagcattcggtggaacgacagacaatgagatcaaccgtatcggatacagtaaatttgcactgatcattgcggtgttatttgtgatcttcattctgatcacctgtctgtgcatcaaagagaaatcaacggtcgatatgaagaacgcttccatcggtgagatgtttcgggcgctgatccagaatgatcaggcaatgacagttgtagttgcaatcgtaatgatcaatacggccttatatatcacccagcagctggtttacttttttttaaaatatgatttcagcccaagtacttatcagggagattttacgctgtttaatatggtcggcggcggatgtcagattttggcgatgatgatcttgtttccggtgctccgcagattcatggacacgattaaaattttctatacctgttttggaatggcagtgaccggatatattttgatcattattatttccgcaaccggaacaagttctgtcgtatggctgtttattccggcggcactgatcatggcggcagtcggtgtgctgaatgtaattatcactgtctttctggcaaacacagtagattatggtgagtttaaaaatagccggagagacgaatccgtcattttttccatgcagacgtttgttgtaaagctcgcctcaggaatcgcaggatttatatcttcgatggttttatttgtgttccatatcagttcaaacaaagaagcggtagtaacggaaccgatcgcagcatcctcccgcatgggactgcgtttatccatgacgatcattccgattgttgtgctggtgatcggatttatcgtatttaagaaacgttatattctgacagaccggaagttagcggagatttccaaagaattagagaaaaaacatcagaattaaaagaggagaaaatcatgattcagacagccaatgatatttttgtgttacatacagaacatacgacctatgcgttccgcaaattgccgacagggcagttggagcatttatattatggaagaaaaatccatgtgtgtgagcctctggatgaaaatgcggtcgcacctttgatcgaaaaacatacctttcagccgggaaacagctgtgtctacgacagggaacatgacgcctatacgttagaggatctgtgtctggaaatgtccgcttatggaaagggagatatcagggagccgtttgtggaacttatctatgaagatggaagtttttcctcggattttgtgtatgaatcgtctgtccggtttgagggaagagaggcgagagatgcagaggatgcattgccagcttcctatgatgaaaaaaatcaggtggaacatctgtgtgtgacgttaaaagacaacaattctgctttgaaattagaacttcattattatatttatgaggattgtgatgtgatcacaagaagtgcaaaactcatcaatgacggtgaaaatgcagtgcagatccggcggctgatgagctgtcaggtcgattttccgacatcggatcatgtgtttacctcctttcatggcgtgtgggcgagggagatgcgaagatgggatgtcccggtggcggcgggaaaatacgtgaatgcttcttataccggaacttcctcaagcagagcgaatccgtttgtgatgttaagtgggagagagaccacggaggataccggggactgctatggattcaatcttgtatacagcggaaaccattatgaggcggtcgaagtgaacagctatggaaaaacaaggtttgtctctggaatcaatccgcagaatttttgctggcagcttccggcaggggaaagctttgaggcaccggaggcagtgatggcttattccaaagccggctacaatgggatgagccagtgtatgcaccgctttgtacgggaacatattgtgcgtggtgcgtggaagaaaaaagtgcgcccggtattgttgaacagctgggaagctgcgtatttcgatatcaatgagaaaaaactgctccagctcgcaaaagccggaaaagaagcagggattgaactgtttgtgatggacgatggatggtttggtcacagggacaatgaccgttcgtcgcttggagactggaaggcgaatacgaaaaagcttccgaacgggttggctggtctctgcaaaaaaatcaacgatctcggtatggattttggcatctgggtagagccggagatggtgaacgtggacagtgaactttataaggcgcacccggactgggcgatggatattccgggcaaaaatcattccgagggaagaaaccagcggctgctcgacctgagccgggcagaggtgcaggactatatcattgggcagatgagtgacctgttctcatctgccaatatcgcctatgtgaaatgggatatgaaccggatcgtgaccgattattattcaaagatacttccaccggagcggcagggggaggtggcacaccgttatgtgcttggactctaccggtgtatgagggagttgacagagcgattcccggaaattttatttgagggatgtgcagcaggcggcaaccggtttgaccttggaatcttatcgtattttccacagatctgggcgagtgatgacacagacgcactgtgccgtgcggagattcagaccggatatagttacggatatccgatgtccgtggtgagcgcacatgtctcatcctgcccgaatcaccagacgctccgaatgacaccgcttgagacaagatttcaggtggcagcgtttggaatctgcggatatgaatgtaatttctgcgatctgaaaaaagaggatttcgatgcggtaaaagcgcagatcgcactttataaagagtggcgcaaagtgctgcagaccggttctttttaccggggaagaaatttttcggatcagggcagcgtgttaggttcatcggctggaaatatccaggagtggacgtgtgtatcagaagaccgggaaaaagcggttggctttctgatgcagaaacttgtgtcgccgaacacgcagtttgaatattatcgtccgaatgggttaaacccggaagccagatatcatttttacaaccgtagtttaaaatacaatgtaaaagagtttggtgatctggtaaacaccgtggctccggtgcatatcaggcaggattctgtcgcacataatctgatcgcaaagtttgtgaaaatggatggtgaggcagaagatttctgtgcatatggcgatgcactcatgtatgccggagtaaaattaaagcaggcatttggaggcaccggctacaatgaacagataaggcatttcccagactttgcatccaggatgtattttatggagcagatgaacgattgacggagtgaaaaatttggaggtgcgtttcttccatggcttctgtgtgttgatagaaatgaaatagcaagaggtgctctgtgaaaatattgtgaggattgtgtaaatttatccatggttcgttttagactttaagtttatgtacattcataaatggacgtctggctctctgtgtccgtctacgaaaaattctctgcaactttatttagcgcaagtaaatgtcagaatcagcatcgtttattgtagggcaaaaattaaaaaatatccagataatttttgccctacttctctgctgattttctgacatgtaacttgcgcacaataaagttgcaaagagagtttttcgtagacggacacagagagccagacgtccattttttgaatgaacataaacaatcgaagaagtctaaaacgaaccatggataaataaacaatccgagctattttcacagagcacctcttgccatttcattttttattgtacgttaaaagccatggaagaaacgcacctccaaatttttcactcggtcaatcgttttttcgcttcgtcgatcacatcctggatgaagtcttctgtgtcgtcgcggacggtctgccagtcaatgtgttccatgtctggcgaatcgaggtcggcgccacggaatacatccggcagatttttttcttttgtgatcgttccgataaaggaaaaagtgccaagcaggtcatcgccctgcatgacggaaaggtttttgacatttatttcgcaaccgttgtcgtctggctgggtggtgatatagccgctcgctgtaaaattgtcgccctgatttgtctcatagagacagtccatatagataaaattcacatgggtgacagacggattgcggacataggtgagtgtcaagcgttctccatttggcatttcataacttaaaatacaggttccggcatctgttccgtcaatgatcatggaagcaccttctgtgatatcggacaaatcgacctccatacggctcatccggcacaggtcggtcagatacagggaaacgcggatgtcatagtccggcgtatccatgcctaaaagctcccagataaaaccaccggaaccctccgggatcgtgacgaggtattcgtggctttttacatcatcggaatctgttcttgtttttccggtttcctcaatctgaatctgtctggtcagttcgataatattggagaagttgtcgtgaaaccattcctgatcaatatcatgtgtcagctccggtgcttttttgaaataagtattgctggtggtcatggcataagaaagattgtctaacattggaaccatgaaataaacggtattaggattcatataaaaatccatctcgcctacattcagcgtcagaacatccatatcggagattatggaaagtttcttctgcgcaaaagagcgctccccggaaatgtccatggaggaggagtatttaaaatttttgatatcgttcaggtaggcttttccctcaaatgagatatccccattgaagtaatcctggcataattccataatgtcaatgtggtaggcaatataagccggatttttcaaggtgtcctgcataaaataaatgacagacataagaattttggcacgcggatttctggaaatataagtcaaacctccgagaaacagaataagcaggcatgcaaaaaatatgccacatctgcgaagaggttttttcttttttctgcccggatctgttttggtctgctccataaaaatgctcctgtttttattcgtaattgtctatttattataatatgaacgcaaaaaataaaccacataaaatggatgatttttataaaaagttaatgtacaatataaaagacataaataccattttaaataattacaaaacagtaagggcagttttgcaattatgacaggagaactagaagatgatgaacgaattttgcaagggaggaggctgcacggcgaagcttggaccgggaattttggacaaggtattaaaaatgataccgaaaaaagctgacccgaatctgctggtcggttttgaccattccgatgatgcggcagtgtatcagcttacggacgagcttgcagtggtgcagacgcttgatttctttccgccgatggtggaagatccttatctctttgggaaaatcgcagccaccaacgcattgagcgatatttatgcgatgggaggagaagttaaaacagcattaaacattgtgtgctttccggagagcatggacgccaacattttaggacagattttacttggtggaaatgagaaagtgacggaggcaggcggcgtgttggcaggtggtcattccatcaatgatgtggatgtgaagtatggactgtccgtgatgggaacgattcacccgaaacatattctggaaaacaatcactgcaaagaaggagatctgctgcttttgaccaagccgttaggagtagggatcgtcatgacggcatcccgcatgaaagcagtgtctgaagaagcctttgaccaggcggtggaatcgatgactactttgaataaatatgcggcagagatttttaaaaagtacgggatacatgcctgcacggacattaccggatttggattgctggtacatctgggtgaaatgctgggcgaaaacttttccgcggaggtgtggacatcacagattccttatatcagggcgtgcgaggattatgtagaagaattttacatcacagccgcaggacagcgcaaccgcaatcatatcggcgcacaggtggcatttgaaaattgcagttttgcgatggaagagattttatttgatccgcagacttccgggggacttcttgtggcaattccggaaaatgaggctgggaaggcgctgaaggagatcgaagcacttggactggactgtggaataataggaagagtgacagagaaaaaggaaaagaaaatctatgtcctgaaataaagaaaatacagcattagctgccgattgaaaaaatgtaaataaacagatggaggcatgaaaaatgaatattcagattgacgcaaaaggaaaacagtgcccattgccggtgatcgaggcaaaaaatgcaatttccggcatgactgaggcaggaatcgtggaagtgactgtggacaatgagattgcagtacaaaatctcaccaaaatggcagaccacaaagggttaaaagcaaagagcgagaaaaaatccgatcaggaatacacggtatggatggaagtgacagaagagtttgtgaaaaataatataaaggatgggaatgtttcatccacaccggtcactggggaaaattgtattccggacatccgaaagaaaaaaacagtcgttgtgctcggtgcagaccacatgggcgagggggatgataagctaggaaaaatgctgatgaaaggatttgtctatgcgctgacgcagctggaggaactgccacagacgattttactttttaattccggtgcatatttaagctgtgaaggttccgactccgtcgaagatttaaagagcatggaggcgcagggcgtggaggtcatgacctgtggaacatgtctgaaccattacggattgaccgaaaaactggcggttggttctgtgaccaatatgtatgtgatcgcgcagacaatgatggaggcagatcacattgtaaaaccataaaggataaggaaaatgaaaaaaaatatcattatcgtccgcggcggcggggatatcgccacgggcacaatttataaactgcaccagagcggttatccggttctggtgaccgaaattgcaaatccgtctgcaatccggcgtcaggttgcattttcggaggcggtctatgagaaaagttacactgtggaaggcgttacatgttattttgcagagaatttgacacgggcatatgaactcctgaagcagaggaaagttgcgttgatgatcgatccggacggagcggtgatccgggaggtgaaaccggcggcagtggtcgacggaatccttgcaaagaaaaatcttgggactataatggatatggcaccgtttacggttgcattaggtcccggatttacggcgggggtggacgtgcatgcggttgttgagacaatgcgcggacataagcttggcagaattatttatgagggaaatgcgattccgaataccgggattccgggtgctatcgcaggtgttgcgaaagagcgcgtaatccatgcagagtgcgcaggtgttttatatggagaaaaaaagatttccgattacgtgcaaaaagacgaagtgatcgcctacatttatccggatgcacaggcgaaggacgcttccgggcagagggaaaaagacggtgcagttgctgtgaaagccactatttccgggattctccgtggactcatccgggacggttatccggtgacaaaaggatttaaaattgcagacattgatccgagagaatccgagtatgaaaactgttttacaatctcggataaggcaagatgcattgcaggaggtgtgttagaagcactgcttcatgcgggaatccttccagagtgatggaaataacgcaggtattcagagaagctgacagagggaaaggcaggaacggttgcaatgatatactttgacaatgccgcaactactttgcagaaaccagaggaggttgcacaggcggtaaaagaatcattttcttatataggcaatgcaggaagaggggcgaatgaggcttctctttttacatccagattgatttttcagacacggaaacagattgcagagctgtttcatatgaaagatggagaacagtctcttggggcagagcgtgtggtgtttactatgaatgcgaccgagagtttaaatattgtgctgaaaggactattgcatccgggcgaccatgtgatcaccactgagatggagcacaacagtgttctgcgtccgctttatgagcttgaggagaagggcgtcagtgtcacaatcgttgattgtgagaaaaatggaacaatttcctgcgaaaaaataaagcaggcaatcggtaaaaaaacaaaagcaatcgtgtgtacgcatgcttccaatgtgacaggtgatggaaatgatatcgcacaaattggagctttgtgtgaaaaatataatctatattttattttagacgcctcccagacggcaggagctgcaggaatcgacatggagcaggatcatatttctgcaatctgttttaccgggcataaaggactgtttggtccgcagggaaccggtgggatcgcactggcagatggagtgtgtgtgaaaccgcttttatccggtggaagcggcgtacattcatttgagagaaaacatcccatggagctgccggctgctctggaggcaggaacgctgaacggacatgggatcgcaggactccatgctgctctggactggatcaaaaagaccgggatcgcagctatccatgagaaagaaatggcgttagctgaacagtttcagcgaggaattgaaacaattccgggcattcacctctacggaggtgaaaaacgggtggcagcgatcgtatcgtgtaatctggcggatcttgattccgcttatgtcagtgactgccttgcagaagattatgggattgcgacaagggcgggggtacactgtgcacctctgatgcacacccattttggcacagaaaaacagggcatggtacgatttagtttctcctgttttaatacgacagaagaggtggagaaagcagtcagggcgatgcaggatattgcgatggaaaaccgtggaaaagtgacggcgtatgtcggagccggcggaaagacgtcaagtatccgaaagcgtgccgagacattgcgcgcagagggaaaaagagttttgatcctcacgacaactaagatgatggtaccacaggagcaggagatatttgcagcgtatgagcagaccgggcaggagagcgtgattttggataccggagctgtttcaaaggagtgcagggcagcagaaaagcaactgaaagagcgggtacagtctgtccttgacacatacggctgctgtgttgcagggagcctgatccccggcacggaaaagtttggaatgctgccggaaaagttgatggaggatctgctatatctggcagatgagatcctgatcgaggcggacggttccgcacatatgccggtcaaagccccggcggagcatgaaccggttctgtttccttatatggatgaagtggtcattgtcatgggcgcacatgcgattggaaaaccgctgcaggaagtgtgccacagagctgactatgcaaaaaagattttaaaatgtgacgcagacaaaattgtgacagcgacagatatcagggtgcttgcggagcagggatatgcgatcccgattcagaaacaatttccatggatgaaaatttcgaaagtaactggaaaagatattaagctgtgtctgacagctgaaaagaaagataaagagagggacaaacaatgattcgatttaacagtgactacacagaaggatgccatacggcaattttagagaagttagttgaaaccaatatggagcagacagcaggctatggagaagatgagtattgcggacaggcgagagagctgatccggaaggcatgtggggatgagcgtgtggatgtgcatttcctggtgggaggtacacagacgaatgtcactgtgatctcagctgcattaaagcattatcagggagtgatcacggcaaaaacagggcatatcaatgtccatgagacaggcgctctggaggcatgcggccataaatgcctgtgtattgaaacaccggatggaaagctgacggctgagcagatcgcagcgtacacagatgcacattttgcagacgagagttttgaacatatggtacagccgaaaatggtatacatttccaatccgacagagatcggaacgatttataaaaaggcggaactggaagcaatttatcaggtgtgcaaaaagcgtggactttatctttttatggatggggcaagacttggctatggactgatgtgcaaggaaaatgacctgacactttctgatatcacagccaacacagacgtgttctatatcggcggaacaaaagtgggagcgctttttggggaggcagttgtgatccgcaatgaggaactgaaaaaagacttccgttacaatatcaagcagcgtggcggtatgctggcgaaaggcagactgcttggaatccagtttctgaccttgtttgaggaaaaccggtattttgatatttccgcacatgcagcgcgattagcggaaaagttaaaggacgaattaataaaaatgggagtgaaattctatattaattcgccgaccaaccagcagttcccaatcctgccggatgctgtgcttgcggaactgaaaaagaaatatagttttgcttatcaggagcgtatggatgagacacacagtgcagtccgtttctgtacctgctgggcaacgaaagaggaaaatgtggatatgctgcttgccgatatccagaaattgttaaaagctgatgattaaaaatatgatgaaagagtggagagaatgattaacatgtcacccaggaaaaacatcttactcatcgcaacaggcggtacaattgcatccaaaaaatcagacaacggattaaaaccacagatctcaccggaagaactgatgcagtatattccacaggtgaaagatatctgtgattttcatgttgtccagcttttaaatctggacagctcgaacatggagccagaacactggaaaatgatggtgcatactatccatgaaaattatgaaaaatacgatggcttcgtcatcgcccacggtacggacacaatggcatacactgcggcggcactttcctatatgatacagaattcaaaaaaaccgatcgtgatcaccggcgcacagaaaccgatcgaccttgagatcaccgatgcaaaatcaaatctgcttgacagttttttatatgcatccgatgaaaactcgcaaggggttcagatcgtttttgatggaaaagtcattgcaggaacaagggcgaagaaagtccgttcaaaaagctacaatgcattttccagcattgattttccatgtctcgccatgatccaggatggcaatatcatgcgttacattccaccggttccgtatgaagaggaagtacggttttatgaggaactggatgaaaatgtgtatctgatcaaaatgattccgggaatcaagccgagaattctgcgcagtgtctttgaaaattatgactgcattattgtagaaagctttggggtgggtggtatcccacgatcgattgcagatgatttttataagctttgtcaggagtttccagaccgtctcgtggtgatgtctacacaggtcgcacatgagggcagcgatatgacggtctatgaagtgggacacgatatgaaaaaatactgccgctttctcgaatcttacgatatgaccttggaatctgtcattgcaaaagtgatgtggatgttaggcaaccgggaggcactgggcggtaatttagaagacatcttttatcaaaatgtaaattatgatgttattttcgggaaaaacaggaagtgttgacagaagtatcatctcccggacagcccagagggaagtgatatgttgtgaagtgtagatgtcagatttcccaaaacagtgtttttagcggaaacctccatctgctagtcaaatgcaagcatttgactctcgcgacattcgccaaattgacacgccagcgtgtcagcttggctcattgttcgcggatataacacaacataggcggctggctcatttgtggtgaatgatagattgcagatgttgtattggcatatgaaaaagttcatagaaaattcagttgattccgtaaagttcctcgcttataatgatattgaggcagagagccttttgcggaatcttagaagtgttatgcacaatacaaaaggagggatgctgacttgaatacagaaatagcaaatgctgtgaatgcagcaggagataaggcacaatatgatactcgtgttaaaaggttactggcacagaagagtatattagcacatattctggtgaaaacagtcgatgaatttaaaggaatgaagccggaagatgttgtgaaatacatcgaaggcgaaccgagtattagcgttgttccggttgagccgggattagcaaatatggaaaaaacagatgctacaggacagcgtatagtaggtcttaatacggaaaatgctgaaattaatgaaggattagtcagatttgatatcattttttatgtccgtatgaaaaatgggctttcgcagattattgtgaatatagaggctcagaaggatgagccgacggaatataaaattttaaaccgggcaatcttttatgtgagcaggctgatttcgtcacaaaaggaaagagattttgtaaatactaactacgatgacattaagcaggtattgagcatatggatatgtatgaacatggatgataacagcctaagccatatccatttgacaaaagatgagatgttaaaaccatgtaactggaaaggtaatctcgacctgttaaacattgtgttaataggaatcacaaatgagattccggagcatgatgaaaaatatgaaatgcaccggttgattggagcattactttcaagtgaactgaaagaacaggaaaaattggatattatagaacatgaatataatattccaatcagtcaagaatttagagaggatgtgagcattatgtgtaatctgagtcagggtattgaagacaaagcaattgctaaaattgtgatgaatatgtataaaataggttatacaccaaatcagatagcagatgctgttggtgtgagtgttgatgaagttgaagcgattattaagaagaaagagcctgcaatggcgtaagctttattaaccaaaaagatctaaaaataagacggcaagtcgtcaacaagttgttgatgatttgccgtctttgttatgggctttagcctgttgagtgcatcggagtttctcccaacagagaaatggagatgtgcgaaacaataaaccacctgttattgatatgccccttgtcaagtagacaggtaaaatatctaaaattggatgtggatgatgcctgcatttccttttgaagtgcaggcatttttctatgcacaccatttctctttatatttgcttattcgtttgttttcaggaatcgggtattctgtgggtacatcagatgacaatgcttcctggcgcacttctgatggggttttacagccatatctgtcctgtggacgttcttcactgtaaaaacgcaaataatctttgattgcatatcttagtgaaacctcatcaatgatttcgtacatctgatacatttcagattttataattccccagaaaccctctatcggtccattgtcgatacaatgtccaactctggacatagattgctccatttcctggttttcaagttttttcttaaatgtcttgctggtatactgaaatccccggtccgaatgaaaaatcggtttggcatccggatttgctgcgattgctttatcaaatgtcttaaatattaatctgttgtcgtttcttgcacttacaacatatgctacaggatatctgtcatataaatctataatggcacttaaatacagtttctttttctctccaggtactttgaattccgttacatctgtagcccatttttgattgggaacagtagcatagaaatctctttgaagtatattttctgccgtttcatccggcttggcataaatatattttttcttctttttacggattacagaatggattcccagctttttcataattctgtggactctgtttttactgtacgatgtatgattgaaatggttgatccaggatgtcattcgacggtatcctaagatatggcaaaaacgttcatcgtattctttgataagttccgcaagtctgatattttcaagttcctcatacggtatttcacgatgtaaccatttataataagcagcccttgatatctcaagctgtctgcacatccattctatactccagtttttctttgtataaaaatatcggattgctaaatattttgattcatggcgtaactttccaagcttcacatcccttcgaattccttcactttttttaacagttcaactaccatatccttttcttccaactgacgcttcaaacgcagattttcacgctttaatcgttctagttcatccacttcggcatctgttttgtgacatcctctccgatccgttaatccatctgcaccatcggtgtcatatttttttacccaggaataaacctggctataagaaacgtcaaattttgcagcagtatttttatagttacgattatgattgatacagtaatcaacgatttctttccgttcttccaatgttgtttttcttcgtgcttctgccatatagacctcctgtttcggattgtaatccttaagctctctattggcattatacattctaatccactttcttaaaagaccggaagagatatcatattttattcctaaatcaatggaagagccgtcacctcttacatattcctcaaccactttcattttaaattccttcgaataagacccatttcgcattttttttgaaaaaccggcaagtccatgtttgttataaatcaaggcccagtcctgaatggttcttgaagaaatacatagttctccacatatctgtattctagatttatttccttcaagataatctataacagcctgttctttttcttcaggtgtaaactttgcttttctggacatgaaaaatacctccaaagtaacagatttttatatttaatctgtctactttagaggtatcatatcatatgcgggtggtgcaacaaatttgttatacaaaaaaatcacctttccgctaaaatagagttgttcaggctactatttaacgaaaggaaaggtgattttaatggcaaatcaaacaaattctatggcacatacaaaatggatgtgtaaatacaaaggtgtggaaataatagaaggacacttaatgccagatcatatccatatgttggtaggtatcccaccgaaatatagtatatcacagtttatgggatatttaaaaggaaaaagtgcactaatgatatatgacaagcacgcaaacttaaagtataaatatggaaatagacatttctgggcagaaggatactatgtgagtacagtaggattaaatgaagcaacaataaagaaatatatccaagagcaggaaaaacatgatatagctttggataaattaagtgtaaaagaatacgaagacccttttaagggttgctggtaatacaaatgcccttttaagggcagcgacgagtcaaaggcattagtagcttgaacgaaagtgaaagccagcgtctttaggcgctggccggtaacaaaggcttatagccgctgagcaaaccacccgtttgacgggtggtactgattttgggcagaagaaaagaacaggtggaagatggtgtggtaaagacagaaccacacctgtataaagctttcggcagtaaccgggataactttgcaaacagcctgcttatgacaagaaagatgcatgacaaaaagtacagcagatataagcagaaggagatactggcacagaagctttcaatatccttccacccggaggataatgacagactgacctatgagcaggcatataaaatagcagaagattttgcgagggagttcttctggtcaaaaggatatgaagtattgtttgcagtgcatacagatacagcacatacacatgtgcattttctggtaagcaactgcaatgtaaaagatggaaagtccttcagacggggaccggcagagctgaaggaaatgtgcagatatttcggggaacagtgcagggaatatggactgacacattcgtatcgtgacagctactatgtaaaggacaaagacagggaacgtcagaactttgcagaatatcagatgaaaaagcgggataagctgtcgtttcgggaggagataaaggtgcttctgcgaaatgccatgaacagaccgaagaataagactttgcaggatgtgattgattatgcgaagaagtattatctgatggatgttcggctccggggcaataccatatcctatgccctgaaatacaggacggataaaaaaggaaagccgatggcggtcagagagagcaggcttggtgcaagatttactgtcgcagggataactgaatatctgaaaaagaaggaaaaaagcagatattgaacaggaatctggaagatatgatgattatgcggaatgggatatatctgatgttaaggaaagtgtcagtatagatacagcagggagtgttcaaaaggaatatgaaaagacagaagggaatatcagtgtatatgagggctttgaccggttctgtgagaaagagaacattcgtgatgacgaggaggaagtattctatggtgctgcgtttgatgaatttaaccgggagtggcagggaatagcagcggaagaacagacagaaccggcttcccataaagaagagcaggagataccaccagattatacgaagatgtccatacaggagcgtgtcagacagctcccaacgccaacagatgatacttcacaggaatttgaagcatataagaacaggatgggatatgatgcggctaagatgaagagtatccgttataagatgagtgtatatgatgaattcttagaggaactggaagccagaaagaaataccatggaacgaaagcatatggcagacagagcacaaggaagcgtgatagaggggaaaggtgaaaataattttgatgatcgtaccatatcggcaattataaaaagtgccgatatggtgcaaaatatttcctgattctgctcgtaaatttccaattctgcaatagcacttgaactttactgcaagacacggataataattatgggataatatatgaaaatgtagatgacctgccgatatacacacagagtggactatgatatgaggaggtgaatgcggtgttatcgattgcaatatgcgatgatgaagaatattttagaataaccgaaaagcagcttatattaaaatatatggcagggaaaaactgcgaatgtaggattgacatgtatgagtctggaaaagaattattagcattaaagtcagcaatttcccaatatcatattatttttcttgatgtgaatatggaagaaattgatggaatagagacagcaaaggaaatacggaaaataacaaaagatgtttttattgtttttgtgacggcttttattacatatgcgttggaaggatacaaggtggatgcagtaaggtatctcataaaggatcatgaaagccttgaaaaagcaatgacagagtgtatggatacaatccttgaaaaaatggattatgaagaaaacgaaatgacttttgattttcaggaggggaaaacaacaatcagtctggaaaatattctttatatagaaagcaatctgcatcgactgatattttacatggtgggtgaagatgcagttcattatacaatatatacgaaactggatgatgtagcagaatcactgcagaataaaggcttttgccggattcataaaagttatctggtaaatttgaaatatgtagaaagtgtggagcgttacagggctgtgctttcaaatggaaaaagtcttgcaatatcaaaggcgagatttttagatacaagaaacgaatttgcttgttacagaggtgaaatttaatggaaatgcatatttttggagtgctgtatacagtgctttttgtaatattgtgtgtgatgtttatcgggactttttcagaaaaaagagacctgtcgggtaaatggtgtcgctatgctgtcatcggagctatgattttggcagactactttatttccgtaaaactggatggtgacattatactgaaagaaatagcaatcattgtgactggaacgctttttatgtgtttgtgtttcagacagcggtggataaaaacagcaatctttgttttgttatatcagggaatctgttttgtgacggattatatttctattataatgctgtctaaatgttttccgacaattacgatggaacgtttatcggaaccactgataaatgcaatgctaggaattttaagccagatgctgcaggtctgttttattatggtgctgcgaagatatgttgtaaaaaaatcctcggaaatgcttaccacattagaatgggtaagatttacaatctttccgatttatacaatcattgtcctgattgcacttctgacaaattttgaaattccggaaagtgatcatcagaaaaatatattgatctgtatcgcgtttgggttgctggtgatgaatattattgttttttgcctgatcaatgatatattgaagcgggaagtacagataacagagaaacgcttattgctggagcgggttaaaaatgaaaccggaatgtaccggacgatttcagaaaattatgataaacagaaaaaaagagaacatgagtataaaaaccagcttgcactcattgcagcgttagccagtgaaaacagagtagacgagatcaatcattatctgaagcaatacaatcatgaaatcatgcagcacacagatttcattgatacaaataatgtaattgtcaatgcaatattaaactcaaagtatcaggagacaagggaaaaaggcattgtatttgttgtaaaggtaaatgacctgtcggatttgagaataaaagatgaggatattgttctgatattgtcaaatttattaaataatgcgatagaagcatgtgagcagtgcgaaaaaccaatcataaaaatgaaatttgtaaaagaagaacatcagattgtcctgtctgttgcaaatacattttcagtcaccccggtaatcgttgggaaaagatacataacaacaaaaactaaggaagcagacagacatgggatcggactggaaaatataaaggaaaccgttggaaaatatgacggttcctgcgtgataaaacatgatgatgataattttaaggttgcaattttaatacataatcaggaaaagtagatgcgatttatagttgtatctactttttttatttccaattctgctttaaaatttccaattctgcaatggatatacagaattagacaggaaatgacgaataaaaagataaagtgaactggagatgatgaagtcatgacagaatatattgcaaatatgttgacaaagaacatgtatatggatggtctgattaaagaaagcgaagagagtatttattcatattccatacaacttattgttgaaaagataataggattttcggctatttatatgatagcgttatttcaaggatatttttttgaaactgttttatttactatatctttatcaaatttaagaaagtgcacaggtgggtatcatgcaaacagttttagaggctgttttattggaacggtaagtatttatcttatatatataaaattgatatacccatatcttcttaataatatgaagataaatatgattatttttcttgtatcggcaatggctatttttgtattaggagcagtaaatcatcctggcatggattggaataaggaagaattcgaggaaaataagaaacttgccagaataacagtatttgtggaattgctagttgttattgcacttacatatcttggaatggtagaaaaatatattctgtttatgagctttggaatgattttatgtgcaattttattaacactgggaaaaataacgggacaggaggtgaaatgtgatgagtaataatattaagaaagagttattaggcttgatgcaaaaagctgtaaaacttgaggtagagaagaatggaaatgaagcttctcgctattgcccggttattttgcatcagcctaaaagacctaaaaaactgaaataggtaatgaaaatattactgtgtaaatggaaggagagaaaagataatgaaattaaaaaacaaagtagccatgttgttggcattgaagcgtagaagtatgtaggaggttgagatgatgcaatcaatatcaagttatattaatcccaatacaagagcacttacatctaattataaaaatacagttattaaagataaggaagcatataacggggcgatgtcgcagcacttactaaatccggtagaggatctggcacaagcgttaaaaacaccaataaaattggcgaaaggtgcttcacttagcagacagaataattctgttaatattgcagaaggacaaagtattcgtgttaatggaggtcatgtgcttacggttacgacgcatggagtagaggtttctggtggagataatccgtatgatacagaatcttatgtaaaagcacagagaatggcagatgcattggcatccatgctgcgaaatgcaggtgggacaatgactactgtagcacattcaaaggaggaatatgcccggtatacagaaggaattacggatgttatgtcttatctgggtatagacacttccaaagattttacggtcaatggtatgaaatatagcaaaaataaagatggctggtatgagtcagaagcgaatagtgaggcgcagacggcatatgaacagttaaaagcgaataacagaacctatcagtttgcagacgaaaaaaccaaaaaacagattgcttatattagtgattattaccttcaaacagtaccggagagtgtaaaagcggcgtggcaggaaacattagaagaaacgggggttaatccatttcagactgatttatccagtacattaacgcagctatctgtggagcaggattttcagacaggtggtaatgacaatatttttggagaaacgaaagaaagctgtttggcagctatcaacaaaatattggagagaatagaaaatccattggcagcaatgacagaggaaagggcagcatatctgcaacaggaaaaagaattttatacagtgttggcatctaaaataggagaataattttatgcatgatgcaaaaatgatattgaaattggaggaatagaagtatgcacattggttctggtctaaatacggtatcttcaatgtaccgccaacaaaaaggcaataatatgaaagcccctgcatctgcggaaaagacattttatacggctgaaacaccaaaggtataccagatattcacaacagataatatgttgtggacaggaggtaatggtacaggtctttcttattgtcttaaatatgcggatgattcgacggatgaaaatcctgtggtgttagcgaaaggtgtggatgaaaacgggaaagagtttgagcaaagaatttatatcaatgatgttaatccatcaaatgctacagtagtcgaaatgcgtgcattggaggcacattacaaagtggaaaagcagggaggtttcacgtctctgccgcttgaagctggtaatatgggacttaacgacagaagagattttatcgcaatgttcaaaaaaagcatagaagatttaaacaaattgggaaggtttgacttatcgttgctttggacgaaaagtatggatacatatcttaatttgccaaatgcaaatagtaagtataaatagtgcttagtcatttgaacataggaaaaaaagagaacttggattacatatcatattgaggctgagagaaatctaataggtgacatagtcggaagaactccgaataatgaagaaaaaatgtggaaaataaaatgaaaaaagtttatcgatagggtttcagtatgatttacatgatacagattataagacttatataaggcagggggataatatggttactgtaaataattctgactattataataacattccagcgggcagggatttaaacaatctgcccaatacttccagcgctggtacaactgtaggatatcaatatgatggacttacagaggaggatcgtttcgtacaaaaagttttgcgggagcattatgataaaatgtacaaagaaaatatgtcgcattctgatccaatggcatatgtcatatcgaaatattgtgatgtgacttcacctaacttttgctcatatatgacagaagaccagcgttccatagcttaccgtacagagaaaagaatgttacaatccggaggaaaacctgtgggtggatttgcacggtatgattatgcattaaggaattacaaggatgtatatacaggtggttcaagaagtgttggttatgtacgcaatactgacagggaaaaacagtatgccagaagtgttgtaaatcagcaaatttcaaatctactttcaaagaatgggatatcaatatcaaaacaggcagatttggtattttctattgacccatatacatatcaactaacggtgtcgggaaatgcagatagagatacattatcgcagatagaaacattactgaatgaaggggataatgcgaaaaatatatggacacatgcgtggatttgtatgcatgatgcagacaatgaaattgttaattcgcaagcaaatatgaaaaaggcgaaccaatattctttatggcatgaagtgtatgagacaacagggtatgatgcacgcaatgcgacatatagaaatggtacttttattgcagaggatggcacagatttacttgccttgtttaaggaaaaggctaaaaatggcgcagggtatgaactttattctaatagatggttggaatatgctaagaatggctggaaaaaagaaaatgatttagtattgaaaataggatttgacagcagtggattgtatgatatagggcaggaaaaaggatatggagcagcacagaatatgtggatgaaaggtgttagccaaagtatgtttgaagctagagtgtaatcaatattatattgattctgagagaaatccaacaggtggcatagttggaaggactccaaataatgaaaggagatatgttaatatggcggttacaggaataggaacatatgcgtcatatacgaatagttatggcaatacacaaaatgctggaaacaaaacgggcaggacatataagaatgctcatgaatataagaactatttaacacaaaaatacgaatgtttacgaagcagggattattccgtaaatataaacagttctcttttgtcaaaggctatgggagatgaaaagacaaaacaatggttggagtacaatttatcgctaataccaaaaacaatagaacagtcaagagcttatgtggcagcaagaggagcaaagatactgagttatagtattactataaatggatatgatagcatgagtttctgtaatgtgtactcaagatgaagttgatccgggaacagaaaaagcaaggaaagaacttgaagaaagactcgagaaaaggaaagcagaaaagaaagagacagaggaaagactggaaaaacagcgtgccgaaaaacaggagcaggaagaacggcaatataatctgaaaattgatggaaaagatgtagatgacctgacaggaaaaatggtggaattgctaggtacttcaacttctataggagtgacagaaaatggagtttcggcatttgatgctttggcataggaactttgatataaaagtgtaagggagcataatgttatgacaaaaataagtaatacaggaaacagttttgatatatggaatctgctcgattggtcaactgtaaacaatggagaaaaatcaaaacagatgcaggatgcggtgccggaattaaaagggcggaaaattagaattgacagtctggaactgtcaaaggaaggtatggcggcactacgtggaagagtacagagcatgccgggacgtattgatatggaagaaatgatgcagatgagagaaattcttccgaaattgaaactgaatccagaggatgatttctattgggcaatgagagaggatatgcagaattcacttgatgcaatcaagcagtcaaaggggaattatacattagatgacctgatttccatccggatggatgcatacaccagacagtataacgctttgcaaaagtcgtatgaggatgacagtcgggatatttacatatgcgatggttccaatgcggagggaaagctacagtaccataaggtatcaaagggagaagacgtgacatttttaaatcaggcatttgatcgtattgcagacagcttgggctttacagcaaatggatgtgaaagccagttaaagattaatgaattatttggtggacagaaagcacctgaactgtctttgccggataattatgaagaaaaactatctggcattatgaagaaagctgcggctacatatgcagaacaaaagaagaatggaaacaatgtgaatgctacaaatctggcactgaaatacctaaatgaagatgcagacttttccgatgtcatgcatcagctattttcaaatatcagaccgatgagaatattgcacagaaacacaaaattatctctattccagaaagcagtcgtgaagaaatgtatgagctgaccaagcgggaattcctgcaaaataatggaattcaaaatggcgatacgacaaaaagaggcgatgtttataataatctctataaaaagatgtctatgaaagattgattagccgcaggaaatacactacaacagtatgaaacggcttacaggcaggcatttattgcaacggtcaaagagcagatccggaatgggatttagggaagccgttttcggcaagtttgttggataatgtatcaagggaagatattgaaaaatcgttacataataacggaaaactctggtacaaagtaatattgatttgcagatttagtatataattcgcttgatgttttatgaaaggtatttcgcagtcagaaaatgtgataaagtgtgtcgttgtggagaaacatgaaaacttatgatagaaaaaagtaaaagtggagtttcaataataggtggtgccgatggtccaaccagtatttttatagctggcaaaatacagaaaaaatctctaaaagttaaaatacgaaatgccatctacaaacataaacacaaaagagcagagaaaaaaatagttgcaggtgcacatacactgaatgaattggtgcaatatgcactgaataaatatgatttagttgaaattaatgtggcggaaagaaaatgtattgaacaacgaataaatttgagggagagcttgattttacagcataagccggaagttttaggagaaatgaaggatattccaaagccggatatttctaatgaagaatctgtcagacaatatttgaataaaataaaggctcgaggtgaaatgattgccgaaatgtcagatgatatcattcctatgaactttcatttatatgaaataagaataggtgatgatgttcttgaaatggagattgattacatttggaatatatttggtatatcctattctggaaacaggaaagtaatgaaaaaatttgagaagatttcaaaggatttgtatctttattatggtgttagtgaagatgatattaagaaaagaacggaaagatattcatcgctggtagcagcattgagttcataaattactactactctagataaaagtagtattccgataagttaaaagataaaagtttaaaaaatagggaggctgttttatgtcaaggataacggattatgcttttttatttcagaaatcatttggaacatcaggagtaaatgcaataggtagttttcagttgtcacaacttaatagcagttctgttcaatcacagctaaaagctgctggaattaatacgaacagtaaacagtataaagcagctgttaagaagatgatgtctgccggaaatggtgcgatgtatggcaatattcagggaataaaaaatctgatgagtcattatgataaggatggagattatattaatcctgtaaatggattggcaggacttttggtgacagatgacaacgagaattcgagaagaaggatcatatcaattccggatagcagcaaagaagaaatgtatgaactgacaaaaaaagaattcctgcgtgaaaacggtgtccacaatggggatacaacaaaacgcacagacgtatataacaatttgtatcgcaaaatgtccaaaaaggacaggctggctgccgggtacacccttgaaaaatatgagagaatttacagacaggctttttatgatgccgcaaaaaaggctgatcctaactgggaaattggtaagccaatcaaagctggagcacttgatgatgttacaagagagactgcagagacaggaaaatcccctgcacaggcaacactttcataaaatcttacatacacacttgacaatatccctctgaagagagaggggcggcgtgaatctgcgtgcccctgtagctttgctatactattgattggctttgagaatttttatatcatccaaagatacaccagagaaagcagcaatttcttccagggaaaagttgttagtttttaacatacgtttggcggtttcaattgccgcatgtttttcaccctctgcaaaaccgtattcatattcagctttccgtaacttcttttcttccaattctttatcatactcaaaaatactcatactgataacctcatttcggtttcgggcaagaaattacgccagaatcccttcccggatgcattcgtccacagcacgttttacagcctgatttaaaggcatgtctgacgcatagtggcgcactctggcaacatactgtgcatattcttttaacatactgcaatgctgcatcaactctgcattgtgtccttcattgacattcaaaacagtaacaattaattcgagctttggtttacctgacagatgttcaaatgctgaggaaagccgaagctctgtacggtcagatatcgcagttgaaccattgtaaaactcgataaaatcactttgattgaccgcattgtaaagtgagagcagattcttccggtcagaaaataacatccggaaaacggtgtccttgtagttccggtttgttgtcggtgttttaacggtgaagtttctctttgacctgttacggtttcttttacattttgccataattgtttcctcctgatatgtggcagaacagcctatgtttaaaacggttctctgcttgcaggagaataacaactgtttgtgattccaagttcatttcgtctcctgcttttcaattgttgatgggtaacaaaaagcatagatacgaatgaagtacgcagattattttgggttaatctgtcgttcttagaatatagatgacaaaaatgtcatgaagattttgtaaaatatgcttttagtcattgtaatacagaaattatatgggaagcaagaaaaattggctgtttacttcaacttttttgtagagtaaaataataaaattataattagtgaaaatttttttggggggaaagatttgcatcttatgatcgttggtatcataatggtgctaaggatactttggaaaggtgggttgaacatgaaatttgaaccgattgaaatcaaggataaaagtaatcggacgattgtactgagaaatgcaacgccggaagatgcagaagatttaatcacgtacttaaaagtcaccacagcggaaacaccatatctgatccgggaaccggaagaagttgtcatgacacaggagcaggagacagcgtttatcaataattgtctgaattcggacagatccttaatgttaattgcaacgttggatggaaaacatatcggaaactgttctttcaatccggttggaaactataagagatatcggcacagatgcgaagtggcaattgctttgtatcaggaattctgcggatatggtattggaaaaatcatgttggaaacggtgctgaaagcagcaaaagagagtggatttgaacaggcggaacttgaagtgatctcggataatcaaaatgcaattgcattgtatgaaaaactgggttttcagaaatatggcacatttccagataacatgaaatatgcagatgagcattatgcgtctgcagactggatgatgaaaaaattataattgctgaaatatattttagataggttaagatgatatggacttgagagtgttgcactactttttgacagtggcaagagaacagagttttacaaaagcggcagaacaattgaacattacacagccaacgttatccagacagcttgcagcgctggaggaggaacttggcgcaaagctttttaaccgcggaggacatcagatcacgctcacaaatgagggactgttgttaaaaaggcgtgcacttgaaatcgtagatttagaggacaagatcgtcagcgagtttaaaggaaataacgattctatcgagggaaaaataacgataggctgtggcgaatttctggcagtggaatcgctggcaaaaatctgtaaaaactacagggaaaaatatccgttagtccagtttgcaatccacaccggaacggcggacaatgttctggaaatgatgaacaaagggctggtggatatcggactttttttagaaccggtcaatacgcagggacttgactacatccgaatgccggaaaacgaccattgggtggtaacaatgcggccggatgatccgcttgcagagaaagaggtcatcacgaaaaatgatctgctggatgtgccgctgatcctgccggagcgcatgaatgtgcagagtgagctggcaaactggtttggaaaggatttcgggaagcttcacattgcatttacgagcaatttgggaaccaatgcgggagtgatggcgttgcacgggcttggctatccggtttccattgagggagcagcaaggtactggcggaatgatctggtcgttcagaaaaggcttttcccggaacttaaaactagcacagtgatcgcatggaggcggaatattccggattcaccggcggtaagcaggtttatcgaagaactgaattagaaaatggatgtgccataaaacgatagcaacagcaagttgctttccacaaactgaatttatctgtatgatatgggttaaggaggcagcagctatggaaacaaagaatatcattttgaaacttcgcatgcaaaaaggactgtcacaggatgaattagtagagaaaatcatggtgacaagacaggcagtatcccgctgggagaatggcgagacagtaccaaatacagaaacattaaaacttttgtcaaaggaatttgatgtttccattaatacacttctcggagaaccaagaaaactgatctgccagtgctgtggaatgacgatcgaggatgattccatattggggcgcgataaagatggtacactgaatgaagaatattgcaagtggtgctatgcagatggaacttatacctacagcaatatggatgacttgatcgatgtctgtgtgaaaaacatggtaaatgaaaacttctcagaagaacaggcacgttcttatatgaaggaaatacttccacggttagattactggaaaagatatgaggaactcagcgaccatgggcaatttgaggcatttaagcagcaattgataatggaaataaatgatctttctatcgagggccttccacagattgacagattaaatgcacttgtaggcaaatatgtgaatcttgaatacagactgccaaatggacagaaagtgaaatttttagatgatcagaaaacatatcttggaaaccagttggaatcggaatttggaagcgagagatgttttggaattgttgcggatatggattttatcatgatttgtacctatgagaaagacggtgcagatccggaattactcttttataaaaagagataaaatattatgcctaaaaggcataacgaaacatacattataagtattagacataatagaaaaaccggttatataataggtgtgtaagatatgacagcatattttatgcatctttttttgattaaaatagttaagattctcaggaggtgtcagcaatgaagaaaacattagttgcatttttcagtgcaagtggaacaacaaaaaagattgcggaaatgatcgcagaggcagcaaatgctgatctgcatgaaattgcaccaaaagtattgtatacaaaagatgatttaaactggatgaacaaaaaatccagaagcagtattgaaatgagtgataaatccatccggccggaaatcgcagattctaatttggatatggaatcctacgatgagattattcttggttttccaatctggtggtatgttgcaccgaccatcatcaatacatttctggaaaagtatgatctcacaggcaggaaaattgttttgtttgcaacttcaggcggaagcggttttggaaatacagtgaaagaattacagccgtcagcaccgggcgcggagattgtggaaggaaaacttttaaacagagcgaataagcaggaaatcgagaactgggtaaagactttataaaaaggagtgtacaaaactatggcaaagatcacacagacagcaggaagaaatgcactcggagaatttgctccggagtttgcgcattttaacgatgatgtattatttggagagaactggaacaatcaggacattgatgtaaagacaagaagtattattacggtcgtagcgttaatggcttccggtatcacagattcttccctgaaattccatttacagaacgcaaaagcacatggcgtgacacagaaagagatcgctgcaatcatcacacatgtagctttttacgcaggctggccaaagggctgggcagtttttaacctggcaaaagaagtatgggatgtaaacgggggcaatcttccatacgaagatgaagcaatgagagcacatgccaaagagatggtattcccaatcggtgcaccaaacgatggttttgcacagtatttcagtggaaagagcttccttgctccggtatctaagagtcaggttggcatttttaatgtgacatttgagccgggctgccgcaataactggcatattcatcatgcaaaaaatggcggtggacagatcctcgtatgcgttgccggacgtggctattatcaggaggagggcaaggaagcaattgagatgaaaacgggcgactgtattaacattccagcagaagtaaaacactggcatggagcagcaccagacagctggttctcacatcttgcagtggaagtaccgggtgaggagacatccaacgagtggtgtgagccggtatcggatgaagagtatgcaaaattgaaatagaactttaaaaggagatttaaaatgtatcagaatacattaacattaaataatggagtaaaaatcccacagttaggactgggaacatggtttattgatgacgacaaagcagcagaagctgtgaaagtagccgtagaacttggttacagacacattgacaccgcacaggcttatggaaatgagcgtggtgtcggagagggtgtcagaacctgtggcgtaccaagagaagaattatttgtggtatccaaagtagcagccgaacacaaaacctacgaggaggccatggcaggaatcaataaaacattagagataatgggactcgattaccttgatatgatgatcattcactctccacagccatgggtggaagtaaaccagagtgaaaaccgttatgtagaaggaaacagagcagcatggaaggcattagaagatgcatacaaagctggaaaattaaaagcaattggtgtatccaatttccagattggagatcttgaaagcctgatggaaactgcagagatcaaaccaatggtaaatcaggtactctgccatatcagcaacacaccagctgaattaattgattactgtcagaaacatgacattgtggttgaggcatattcctcaattgctcatggcgttattttaaatcagccggagatcaaagcgatggcagaaaaatacggtgtttctgttccacagctctgcatccgttatacgttacagctcggtgtaatttctcttccaaagactgcagatcctgcacatatgaagacaaatgctgaggttgattttgaaatcagtgccgaggatatggaagtattaaaacatttcaaaaaaatagaaaactatggtgatagcagtgcgttcccagtatatggaggaaaaatgtaagatgaagaagccatacacaatctgtcatatgatgatttccattgacggaagaattgactgtgccatgacatccaaacttcgtggtgtgaatgattattacacaacactggatgaaatcaatgtacctacgaccgtgagcggaagagtgacggcagaactggaaatggcagaatcgggaacttttgtctcgaaaaataacgaaagttacggacaggaaggtttttcgaaacaggcagagacagaaggttatgaagtcgttgtggattcgaatggaaaactgcgctggccggatgcttcaggtatgagtaaaccgtatctgattctgacaagcaaaaaggtgaccaaggaatatctgcaatatctggacgaacagcatatctcatggattgcatgtggagatgagcatgtggatcttgtgcgtgcatcagagattcttttcgaacagtttcatgtaaagcggatgggaatcgtcggtggttccaagatcaataccgcttatttggaagcaggacttcttgatgagatcagccttctgatcggtgcagggattgatggaagaggcggtatgccggcagttttcgatggtctttccatgagccatgatgctacagcgttaaagcttatggatgtacagaaatttgacagtggagcggtctggatccggtatcagtgttaaaaagaaatcgctacattctgggaaaccagggtgtagcgattttgctgtttaaaattgtattttaacataaaaaagttataattcataaaacaagtcaagatggagggaatatgaattatcttagtaaagtacttggaataaacgttagttatgagaggtctgatttgaatcattatccaaattttatatgtacgagatattgtttacggatagtatcgttagaatgtcaaagagtcgtttttctttatcctaagacagaactagagcggattgaaacattgaaaaaacatattgaacggataaaaaatacggaaaagcggatattcggcattggcggaatattctatgctaaatgcacccaatataaaatgctactcatctgaaaaaatttccaaatggaagggaagtgcaacgaatactcttcatgattcaaaaatgcaggtggcagttgaaatgtggagatataatccatgtaaattatcaaatggaagtgttgtagatgagctttcgctggcattggctttaagggaggatgcagatgaacgtgtcgaagaagcagtagaaaaaatgcttgacaatttgtggaggaggatagatggttacaggaatggatggatatgacagatcgcagggcagtaggagagcatgttgatagcaaaaatatcaaaaaacataaaaatgatgtattccgaaaaaagcagatatagaaatggaaaagattttctgaatctgaaaactgccctcgtttttaacaaaatccatccggtattgttaaggatacctggtggattttccattttctgcaatttataataatgttaaaaataattgcaaaggtggtaaaaatatgagaaagttatacatagacaatatcagatggatcacagttgtgcttgtggttttgtatcatattatttatatgttcaatggaattgaaacatttggagtgatcggaccattttcggatgtgcaatatcaggatgcatttcagtatatcgtatacccatggtttatgctgttgttgtttgtaatatcaggaatgagcgcaaggtatgagctggaacatcgctcagaaaaagaatttataaaaaaaaggacgggaaaattattggttccatccacccttgggcttttagtgttctggtggattttaggatactacaatctgctgatcagcggtggattagaggagatggcagcagttccaaaaccggttttatttatcatcatggcagtcagcggcataggaccgctatggtatatccagatgttatggattttttcagtactgctcatatgggttcgcagagtggaaaaagacagattatggaagctgggagagaaagcggacgttccatttcttgtgctatttgcaattgtgatctggggcgcagctcagattttgaacacaccaatggttgtggtataccgtttcggtatctatggggctggattttttgtgggatattttgttttgtcccatgatgaagtgatggatcgtctggaaaaatgctggctgccgcttgcggtgtgtgccgtaattttagcggctgcatttacagtgttatactggggcagaccatacgccgagcattcagttttagacacaccgctatgcagcctgtttgcatggatcgcggttattgcagctttggctttcatgaaaaaatggggggatatttccaacacattgacaagatggatggcagcgaaatcatggggactttatttattccattaccttttcattgcgatgacagcatattatctgaccatgtatacaaaattgccggcagtgcttctttatctttttgtggcagcagcgggatttgccggtgcatatctggcttatgagatcatccgccgtattccggtgctccggtggatcgtctgtggaattggaggaaagaaaaaataatgtttgcagaaaatctcattcagcttcggaaactaaatcatatgtcgcaggatgaactggcagatcagatcggtgtgtcgagacagacactctcgaaatatgagacaggggaatccctgccggatatcgaaaagtgcaaaaggctcgcagatgtctttggcgtgacggtggatgacctgatcaattatgaaaaaaaggattctcttggcttagaagttccaccgaagggaaaacacattttcggcatggtaaaagtaggtgagaaaggtcagatcgtgatcccggcaaaagccagaaagatattcgatatcaagcccggagataatctcattgtgcttggtgatgaggggcagggcattgcgctgatcaaggaaaaaggactgcttgatcttctgaaagccgccagggaagaacattaaaaaacttcccacatatcgcaggaaaaccggatatgtgggaagttttttaatgtgttttgcggttgatataattggtcttatatttggagtaaataattttctggctgctgtataggccatagtatccggaaagcatgtagctgaatgcaacggcaagcaaaaagtaaggcatgccgtcatagccgaacaactcgaagctgatgagcagggcagtgatcgggcagtttgtcactccacagaaaactgcggccatgccgactgccgtacagagtgtcggtgaaaagcctgacaggtttccaaacagacagccaaatgccgccccggtaaaaaacgatggaacaatctcgccacctttaaatccggcacctaatgttaaagcagtaaagagcattttcataaaaaaggcttccgggcggactgtgccgtcaatacactgttcaatgatattgattcccgtaccgttataattctggttgcccacaagcagcgttaaaatgagcacgaaacatccaccggcgaaaatgcgcacataaggatttttgaaaaacttcttataaaggtgttctgactgatgcagcatgacacagaaaataatgctgacaccggcacatagaatcgcaaggacagagatttttacagcacttgtgatcttaaaagcaggaatctggccgatcaggaacatttcctgtgagacaccaaagaattctgcaacagcatgtgcgaccagtgaggagatcacgcacgggactaacgccgcataatacataacgccgacactgacaacttccatggaaaagacagccgcagccatcggtgtgccaaacaatgcagagaatgcggcgctcatgccgcacatgatcataatgtgtttgtctttttcatcaaagcggaacagttttccaagaccgtttccgatacttccaccgagctgtaacgcagcaccttcacgtccggcagaaccaccaaacaggtgggtgatgagtgtggagataaaaatcagcggagccatgcgaagcggcagatcttcatcggaatgtatcgcagataatacaaggttggttccggtatctttttcatcatgaagcaggcggtaacatccgacgatcaggataccactcaccgggagcagaaaaataagccacgggtttttggttctggtcagtgtgaccacatacatgccgaaatagaagagtgtgccaacacccccgacaagcagtccggagacgatggagaaaagcacccatttggcagaggtttttattcgtttgaaatcatgttgtaatttatgacggatcagttctttcatatgttctttccactttcccttttgatcagaatgaaacggcagtgcccggatttcatttccataatattatagtagcatttcaaaaaatctttttcaatgtaaaacatcattgcattctaatttcatgaaataaaagcggcagggcagaaagtaatactttgagcaaatttccaccagaaaaatgaaaaataagaaaaaagtatcttgctgatatacaatttacacaaaaaacaaaaacaaaaattatgaaatatagagaagataacgattcagtattgcttttttatgaaaaaagaatataatacaattatcaactgaaaacgttaccgaaaacaataccgaaaatgttaccgggaacatttcagcgaagtggcagagtgccagaacaatcattgcacaatacagatgtgcagaaagtatacgggaggaaacgacatgaagagaaaagttttatcagtaatgcttgctacagcaatgacagcaactttatttgcaggatgcggcagtgatgcttccaatgcagacagtgcaaacagtgcagatgcaacagcaagtacaacagaagcaggagatgcgaaaacagatgcagcagcatcaggaagtggttccgtttattatctgaactttaaaccggaacaggatcagcagtggcaggatctggcagcaaaatacacagcagagaccggaacagaggttacagttatcacggctgcagatggtacatatgagcagacattaaaatcagagatggcaaaatcagaagcaccaaccttattccaggtaaacggacctgtaggacttgcaaactggaaagattattgcatggatctttcaggcagtgagttatattcacatctgacaagtgatgattttgtattaaaagatggaaacgcagtacagggtatcgcttatgttatcgagacttacggtatcatttacaataagacaatcttaaatgactactgcacaatggacaacgcagtgatttcttctgttgatgagatcaacaactttgcaacattaaaagcagttgcagatgatatccagtccagattagatgagattaatgagaagtttggatacgatcttcagggagcatttacttccgcaggtatggatggatcatctgactggagatttaaaactcatttggcaaatcttccaatttactatgaatacaaagacaaaggaattaattctacagatgcaatagaaggaacataccttgacaattacaaacagatctgggatttatacattacagattccacctgtgatccgggaatgctctcatctaagacaggtgatgaagcagaatctgaattcggtatggaagaggcagtattctaccagaatggtacatgggagtatggtaacctcacaaatgaagagaatggttatcttgtaaccgctgatgatatgagtatgatgccaatctatattggtgttgagggagaagagaatcagggactctgcacaggttctgagaactactggtgtgtaaacagcaaagcttctgcagaagatcagcaggcaacacttgatttcctgaactgggttatcacatctgacgcaggacgtgaatccatagctcatgaaatgggatttacaacaccatttgatacattcacaggcgaatatgaagcagataatgtatttatccaggcttctaaccagtacatcgctgatggaaaatattctgtaacatggaacttctctactattccatctgagacatggaaagacggtgtaggttctgcattattagagtacgcacagggaacaggtgactgggacggcgttgtcagtgcattcgttgacggatgggctactgagtatgcagcagctgcaaacaaataaaaagtaatgatgaagtaacatggaaagggtgtgtggcctgccactcaccctttcagattattaaggttttatgagaggatggaaattatggagaaagcaatcaaaaaatattttcctgtttttgcactccctacattagtggcatttacaataggttttatagttccttttattatgggtatctacttatcattctgtgaatttacaaccgttacagatgcaaaatttgtaggattaaaaaattatctgcgcgtgttcagtgatccgacatttatgcatgcattatggttcactgcattattcaccattgtatcagtgctgacgatcaatgtttttgcatttgtaattgcgatgcttttaacaaagggaattaaaggtacgaacttcttccgtacagtattttttatgccaaaccttattggtggtatcgttttaggttatatctggcagatcctgctgaatggaatcttaggtcattttggaagaacacttacttattcttcttcctatggattctggggattgatcattttaatgaactggcagcaggtcggttatatgatgatcatttatatcgccggcatccagaatattccgggcgagttgatcgaggcggcaaaaatggacggggcgtccgactggcagttattgaagagtgttacgattccaatggtaatgccatccatcacgatctgtacattcttaacactgacgaactctttcaaactgttcgatcagaacctggcattgacagcaggagagccgtccaataattcgcagatgcttgcgcttaacatctttgagacattctatggaagaaccggttgggaaggtgtcggtcaggcgaaagcagttatcttctttattatagtagcagttatcgcactggcacagaacagactgaccagaacaaaggaggtacagcagtaatggcaaagaaagtaaaagaaaataatgaggtaagtgctgtaagaagatcaaaacacggaggagtgctgaccgtatttttcagtctgctgaccgttttttatctgtatccgatttttctggtgctgatcaattccttcaagaaaaaaggatttatcacaaaaaatgcatttgcactgccggatgagagatcctttaccggattgtcaaatttcatccggggtattgaaaaaacaaacttttttcaggcgtttggctactcggtgctcatcaccgttggctctgttgcagtgatcatcttatgcacctccatgtgtgcatggtatattacaagagtacataataaagtgaatgcaaccatttatatgttatgtctgttttccatgatcgtaccattccagatggtaatgttcaccttgtcaaaactggcaaatatgatgcatctgagcaacccggtcggtatcattttagtataccttggattcggtgcaggacttgcggtgtttatgttctgcggctttgtaaaaagtattccgatcgagatagaagaggcggcgatgatcgatggatgtactccgatccagacattctttcaggtggtatttccaattatgaaaccaacggcgatcaccgttgcaattttacaggcaatgtggatctggaacgattatttacttccttatctggtattggatatcaaaaaatacaagacgattccaatcgtcattcagtacttaaaaggtggttatggagcagtagactggggtacgatgatggcaatgcttgtacttgcgatcgttccaattgtagttttctatgtggcttgtcagaaatatattattgaaggagtagttgcaggagcggtcaaaggctgatattacagtagaagattgtaaaaaatacatgttttacgaaaaaaaacgaaaaaaaacagtagacaggaaagaaaaatatggttacgataaaggatatagccagggaatcaggatattccatcagcacggtttccagagtcctgaatcatagaaatgatgtcagtcccgatgcaaagaaaaaaatcgaagaagtagttgaaaaatttcattttgttccgaataataatgcgaagcatttgaagcagagcaatacgaaaacaattgttgtattagtcaaaggtatttccaatatgctgttctccaacattgtggaggagatccagcagatgatcggaaggaccgactatacactggttgtttcctacattgacgaggacgacaatgaggtggaacaggcattacagctctgcagggagcgaaagccgttaggacttctgtttttaggtggtaacccggaattttttaaacagggatttgcaaaggtggatgtgccgagtgtgcttgtgacaaaccgggcaaataatcttccatttgagaacctttccagtgttgcaacagatgatattgccgcaggaaagtgtgctgtggatgctttgcttgaagcaggacatgacaagattggtattatcggtggtgatccggtaaaatcatacaccagccaccagagatatttaggatgtaaggaaagctttgcagaacatggtaaggaaatggatcttgaagtctgctatgagaaagcaagattctcatttgacagtgcttaccgggcgatgaaacgtctggtggaaaagtatcctgatctgacagcagtatttgcaatgtcagatgtgatggctatcggcgcgatccgtgcgctgcgcgatatggattatcgtgtaccggaagatatttctgtgattggttttgatggcaccgtattagcagaatattataatccgaaactcgccacgatcagacagcagtatcagacacttgcagtgagaagtgtggagatactgtttgggcagatcgaactgaagaaagagccgatttatgaggtggttccgtttgagttcgcaagtggggagagtataaagaatttgaaataggagtttttgaactcaaataggaggaattattgttatgagaagcagcggtgttttaatgcacatttcatccctgccatccccttatggaattggtacaatgggaaaagaggcaagaaagttcgtagattttcttgataaatcaggtcagaaatactggcagatccttccaatctgtccgaccagctatggtgattcaccatatcagtcattttccagttttgcaggaaatccttattttatcgatcttgagattttatgcaaggaaaaactgttaaaaaaagcagagtgcgaatcttttccatggggcagcaatcctcattatgtagactatggggttatgtacaattcccgctatgcattactgaaaaaagtctatgcacgtttcatgaaaaaacagccggaggattttgcatctttttgtgagaaagaagcagaatggctcgaggattatgcactgtttatggcattaaaagatgcccatggcggaattgcatggtttgaatgggaaaaagaattaaagacaagagaacagaaagcattgtcagaagcaaaagaaacttatgcagatgacattctgttttacaaaatgctccagtatctgttcttcaaacagtggtgggcattgaaggaatatgtaaatgaaaaaggcattgagatcatcggagatgttccaatttatgttgcaggagattctgcggatgtatgggctaatccggctcagttctacttggatgagaacttagatccaatcgatgttgcaggatgtccgccggatgcattctccgcagatggacagctttggggaaatccgctgttccgctgggatgagatgaaaaaagacggttatagctggtggacaaaacggatcaaagcaatgtcaaaattatatgatattgtacgtatcgatcatttccgtggatttgattcttactatgcgattcctggaacagacgacacggcacgtaatggtgagtggagagagggtcctggaatggatctgtttcatgcattggagaagaagcttggcaagttaaatatcattgtggaggatcttggattcctgacaccttctgtattgaagctcgtaaaagattccggtttcccgggtatgaaagtggtacagtttgcatttgattccagagagggaagcgattatttgccacataactacccgacacactgtgttgtatacacaggaacacacgacaatgatacgatccttggctggatgaatacagcaccgaaggcaagtgtaaaatttgcaaaagagtacttaaacctcacaaaagaggaaggttataactggggcatgatgcgcggtgcatgggcttccgtcggtgatctcgcaatcgttccgatgcaggatatcatcggtgtcggttctgagggacgtatgaatacgccatccaccttaggcggcaactgggagtggagagcaaccgcagaccagattgacaacaaacttgcaaaacgcctttataaatacatgcaaatgtacggacgtgtaaggaaagatgtgaaggaagaagccaaagaagaagctaaagaagaagcgtagataataaaaaagtaaattgtagaaagaaaagtcgcacagacaacagtgatttcctttgtgagctctgcgagcaggaacatcacagttgtctgtgtgacttttctttttgccaaaaacttgaatatctacgcttcccaatggcttgtaaaaatggagaaaaccatctataataagtaggctgtggtatatccacggaatacgtgagagaagaaggttttacatatgctgatcgagaaatttttaaaacaggcaaaagaagagattatcatggataccgtgttatccgatgagtttatggataaagtgcaggacaattttgcaccgatcgagagtctgatggcatactatcggtgtgcaattatggaagtagagacaaagttcaatgttttgaatgagcagttttccctgcaatatgacagaaatccgattgagtctattaagacgagagtgaaatcgtttgacagtattttaaagaaagtgaaacggaaacagattccgttttcactggaatccattgaggaaaatatcaatgacatcgcgggagtgcgtgtgatctgttcgtttcaggaagatatttatatgctggcggattgtctgctgcagcaggacgatgtcagactgatcgagcgaaaagattatattaaaaacccgaagccgggtggataccgcagtctgcatctgattatcgaagtgccgattttccttgaaaaagaaaaacgtccgatgaaggtagaggtccagcttcggacgatcgcaatggatttctgggcaagtctggagcataaattacgttataagaagaacattccggaaagcgaggcagagtatctggcaaaagaactggtggagtgtgccggcatcagtgcatccctggatcagagaatggaagctatccgtgaccggatggaagctgcacaggagaagatatcatgacaacacaggaaaagaacgggatcacagagggagtgatctggaaacagctgttgattttcttctttccgattctggtgggaagtttttttcagcagttatataatacggtggattctgtcattgtgggacagtttgtcggaaaagaagcactgtcgagtgtcggcggctctgccgggcagatcataagccttgtggtagggtttttcacaggcgtgtccacgggagctaccgttattatctcacagtattttggtgccggaaaaaaagaggagatagaagagtctcttcacaccgcttacgcatttgcacttgtgggaggacttgtgctcggaattgccgggatcgtgtttgcaccgcagatgttacgctggatgaacacaccggaggaactgatcgcagaatcggtactgtacgtgcgggtgtatttttcaggactgatttttattttcatttacaatatgggtgctgcgattttaagggcagtcggggattcgaaaagaccattatattatctgatcgtctgcagtgtggtaaatattatattggatcttttactcattctggtcatcccattaggcgttttaggtgcggccattgccaccctgatcgctcaggcagtcagtgctgttttggtgacagttacactgatgtaccgcacggggggcatgaaactgtgtctctcacagatccgcatgtacaaaagaatgctgcagagtattttaaaaataggtcttccggcgggatttgaggcaatcatgtacagtatttcgaatattatcgtgcaggtgtccatcaataattttggagtggacacgatggcggcatggacggcttattccaaaattgattttattttctggatgatcaacagtgcattcggaatttctgttatgacatttgtaggacaaaactatggagcagggaaatgggaccgcatccggagaggtacaaaaatctgtcttggcatggcactgatatcggcggtttctgtgagtatcatcttaatgtctgcagagagatttctgtttggaatctttgtcaatgatgtgggcgtggtagagatcggtatccgcatgatgaatgtgatcgcaccggcgtacttattatttgcctttatcgaagtgttttccggggcactgcgtgcacagggagcagtggtagtctccacgctgatcacgatggttggcatctgtgtgctccgtatgatctgggtgacacttgtggcagctcacggaaccttagagcaggtcatcatctgctatccgatcacatgggcggcaggtgcgcttgcgatgagcatctattacatttacaagcagagaaaaatatttcaggcaagatagtcactaaaatacgtgaatatataagagaaacctatttattttgataatgaacaggtttcttttctcatttattgcgaaactcataaaaagtaaattaaattgtgaaaaatcgacaaaagcttgagaaaacactggagagcggtcggttcttagaaggcaggtgcgacaatagtcgtgactggcttcttagtaccgttaccagcgacacgtagcgaaagcgtgttttcgaaaattttgttgatttttcacaatttgacatagcatgagaagagtttcgcccccaaaatgaaaaagatacaagaattctattgacagatatataaatgactgataacataaacatatgaacagatattcatataacacggaggtgaaatgattggcaattaatgatgtagaacattgtgaaacgtgcgagatccacgaggataagatcaaacaggtgagtgagcatatgccggacgaagatgaactgtacgatctggcagaactgtttaaaatattcggtgattcaaccagaatccggattttgtatgtgttgtttgagtcagaggtgtgtgtctgtgatcttgcggaaatgcttcatatgaaccagtcagcgatttcccatcagcttaaaatattaaagcaggcgaagcttgtaaccggcagaagagaaggcaaatccgtgatttattcgctggcagatgaacatgtgcgcacgatcatcgatcagggaagagaacatattgaagaataagaaaatggaggaatggatcatgaagaaaaaatttaaattagaagaccttgactgtgcaaactgcgcagcaaaaatggaagatgcgatcaaaaaaatcccgggtgtcaacgatgcaagcgtaagctttatgacacagaaaatgagcattgatgcagaggatgcaaaattcgacgagattatgaaagaagtcgttgctgtttgtgcaaaggttgagccggactgcaaaatcttattttaatgaatcaatggctgctgcgtgatgcggcagccatttctatcccaaggagagtaatttgtgcctgcagcataaagtctgcaggttacagaaaggcatggtaaataatatgacaaagaaacagaaaaagatgctttaccgcatcattgtcacatttctgctgtttgcagtcctgatggtctgtgaacacacgggacggatggacggatggaacaaaattgtgttatttgtgatttatctggttccgtatctggtaattggttatgatattgtatacaaggcggcacgaaacatcagccacggacaggtgtttgatgagaatttccttatgatgatcgccacattcggagcgtttggcgtaggtgaatattccgaggctgtcgctgttatgctgttttatcaggtaggcgaactgttccagggctatgcggttggaaaatcccgccagtccatttctgatatgatggacatttgtccggaatatgccaatatcgaggaagacggagttttaaaacaggttgatccggatgatgtggaagttggaagcattatcgtagtgaaaccaggggagcgtattcctttggacggtattgttgtggagggtgaatccctgatcgataccgcagcactgaccggcgagtcggtaccaagaagtgcaaaagccggggatgagatcatcagtggttgtgtgaacggaagcggaacattaaaagtaaaaacaacaaaagagtttgatgattctacggttgcaaagattctggaacttgtggagaatgcaagcagcaaaaaagcaaaagttgagaatttcatcacacgttttgcaaaatactatactccggttgtcacaatcggtgcagtgatcctcgcaattttgccgccactgatccttggcggcggatgggcagaatggattcagagagcatgtattttccttgttatttcctgcccgtgtgcgttggtgatctccgttcctttaggattcttcggaggaatcggtgcagcgtctaagatcggtgtccttgtaaaaggaagcaactatttagaggcagtggcagagatgaccacaattgtttttgataagaccggaacactgaccaaaggcgagtttaaagtgacagatgtcatcaccgaaaacagttccaaagaggaactgatcgaacttgcagcattgggagaaggctattccaatcatccaatcgcaaattccatccgtgaagcttacggaaaagagctggatttaaaccgtgtgacaaacacagaggaaatcgcaggacacggaatcaaagctgtgatcgacggaaaaaccgtattactcggaaatgaaaaactcatgaagtcagagagtattttttatacaccttgcaagagcatgggaacagttgtttatgtggcatgcaatggagtatttgaaggagcggttgtcatctccgataccattaaagatggagcaaaagaggcaatccacgacatgaaacaggtaggtgtcagacatacagtcatgctgaccggagaccgcagagaggcagcagagacagtggcacagacacttggtattgatgaggtacatgcagaactgttaccgggtggtaaagtagagcaggtggaagcactcttaaaagccgaaaagcaaaaagagcgtcttgcatttgttggagatggaatcaatgatgctccggtactcaccagagcggacattggaattgcaatgggaagcatgggctccgatgcggcaatcgaagcagcagatattgtcctgatggatgatgatgtgaccaagatcgcatcggttgttaggattgcaagaaagacactccgcattgtaaaacagaacattgtatttgcacttgcaataaaagcacttgttctgatcctcggcgcacttggtatggcgaatatgtgggaggccgtatttgcggatgtaggagtttctgtcatcgcaatcttaaattccatgcgtactttaaatgaaaagtaaaaagaaatattcatagtagtcaaaataaaaattcggattctcagtcaaaaattgtcagaaataagttgactttatatctgtaaaaaagtactatttttgtaggagaaaggatgacataaatgagacagtcctaaaatagcaacggagaaagggaaaatgaacaagatccttgatttgatttttgaagatgtaaagaatgagaatgaaacaaagaaaacagcggtgacgctgcgtatcagtgcgctgatcttcattggatattttctctgccttatggcagttttctgtagcatgggcgactggatgaatgtgggtggctgtctggtgtgcggagtatgctatgtgttatctttttacacaacgtactggaatcatacgagagagtcagcgtggatctcacagatacttatgatcgtgtggatcatcctgtttattgtgatgtttggctgggattgcggagtacagcattatctgtttgcatttcttgcgctgaactttacggtgagtactgcaggagagcggagaaaagtgctgaatgctgtcggagcatgtgcactccgtctggctttgtatgcctacgcccggaattttgaaccatacagcccgctggatcccggcataagtgttctgatacagattttaaataccatttttatttttgcgcagatcaccgctattatgatcatatttacgaaggatgcccagaaaatggaacagaagcttgtacggtataatacaaaattgcaaaagatcgcttctgttgacgcacttaccggtctttggaaccgccggagcatgtgggaatatatccgtgcagtggagtatgattatgaaataggaaatgcaggctttgtatcgatcgccattgcagatattgatttctttaaaaggatcaatgatacctatgggcatgatgcaggtgatgaagtgttaaaggcagtggctgaacttttcatggacaaaatgaaaacatatggaagggtgtgccgctggggaggcgaggagttcctgtttgtattttatggcagaaacggcgatgcggcatatgatgtgttgcaggagatttatgacgagatccacaggctgacggtgtcgtatgaaaatgaggagatccgcattaccatgacgtttggactggaagagtacgataagaacgatggtatggaaatggcgatccgcagggcagatgagaagttatatcagggaaaagagaccggacgcgataagatcgtttattgaagcaggtggcgtatctgagaaaaatatgcatattatgcagaaaatactatggaattttttggaaaaataaggtataatatgctatattgtgaaaaggcttacatgataacaagagaggagttaacgaaaaacaatggaagaaaataaatatcgttataatgacatttcggaacgattgcggagaatgaatagaatatatatgggagccacgatctttatggcggcactgattttgttgtatctgtggatgaaacagatgaatcataacatcaagacggtgaccgtctatggaaatacggttcttttacttgcatttaccgtggtgaacgcggttatttattgcaggaataaggcaacaagcaagttaaaagtggcggtaaccatggagatgggaattgagtatttgctgattggtatgcagacagatgcgcattttattacctatatactgattgtttctcttgcattacagattccttattatgataaaaagggattaaggagaacctcaattggacttggaattttatatatccttgtgactgttgtacagtctgtcaagggaattaatgtgatagatgtggataccatctgtggtatttggggtgtgcttggaattctctttatcatcgcaaaaatcggtgatatcacgattatgtttaatgatgatgcacttggctctatcgcagaagaacatgagaaggaaaaacgggtactggaaggggtgcttggcatttcacaatctatccagacagaatctgtaaagagcggtgaactgatcgaaaagctggttggcgtgacagaatctgtaacaaacagcatgcaggagatttcagcttctgccaatacaaccgcaggcagcattgaagaacagagtacaatgaccaattccattcaggatgcaattggtgtaaccggagagagttcaaagcagatggtggatattgcaatgaattccaacgagagtattcaggaaaatatccgtgtaatggaagaattaaggacacagtcagaactgatcacgaatacaaaccacgaagtgacgaccgcaatgacaaagcttcagaacaaaacaaaagaagtggaagagattgcaggaatgatcttaaatatttccagccagacgaatcttcttgcactgaatgcatcgatcgaaagtgcaagagccggtgaggcaggccgcggatttgctgtcgtggcagaacagatcagacagcttgcagagcagacaaagaattctacggagcagatcacgagaatcgtcaatgagctgaatgagaatgccaatgaagtagtttcttctgtggaagaatctgtagaggccgttgagagccagaatcagaagatcgttgcagcatctgagacatttgagatattgaaccgtaatatgacagatctgatcgatcatatcgaggaagtaaaccggcaggtggatggactttctgagtctaataataagatcgtggaaaatatatcccagttgtctgctgcaacagaggaagtgaccgcaagtgcagaacaggtacatggcatgagtgaacagaatctccagtttgcagagcaggtacagcaggcagtagataagatgcgtgcaacggcagatgatctgaaaaagtatttataagaaaagagctgcaggatgcagccctaaagaaaggaaaaatgttccagagcgaaggcgataccgtcttcgctcgctttttttgtgacaaaggacacccggtcaaaaagagaagccgggtatgcatttcccatcgcaacactgttcgggagataggagagcatcggaagatcattgttgctgtctccgaatgcataggcatcctcttttgacagattgtaatgatcaaggacaaactggattccggttgctttgctgtagccgtgagggacaaattcccggaatgtgccgccccggtcaatgcagttgaaatgtacgtcgctgatctttcggaaagcctgcagctgctctttgtcctgaaaccagataacaaatttatcacaggtaaaatccggtgactccagatccgttggcattgtataaccgcgtttcacgaaagcgtcatattgtgccacggcatccggatgaatgaccggacggaccggatcataagcaaccgcagtggatgattcgaaaacaatgtccacattggtgtctcttgctgcttttaacagttccattgtaatttcatgggactgtgtgacatgtaaaagattctttccgccgcagtaaatatcagtgccgcatccgcagacaaatccgtcaaagccgacttcctgaaagcgtggctccacgttctggatacatcttccggtatttaaaaacatcaggtttccgtttgctctggcttttcgtatcgcagtgatggcactctgtggtatggaaccgtcgatttcggaagttaaagttccgtctatatcaaaaaaagctatttttttcatttgggattctccttttccatcgtatttcaaacgattgcattgtatagtatttcttggaaatagtcaaagaaaatatgaaaaatcagtaaattcggataccataagcatgaaaaatatggtaaaatatgtataactttgatgaacacggaggtttcggataattatggagcaggataacagtaaagtggcctgggggaaagccttaaaaccgatatttgcattgttgcttgtcattgttttatggcaggtgcttgtattggaaatgttaaagaatggaatcatcagcacgttgattgcagttgtgctggtaagtgcggtcagtgttgtgatttttgggatcgtattctgggttgtgaaatcactgctgaaccagtttcttacaatagcccagggaaaaacagaagatgaacaggagcagacgaagatcggagaaaaagcgaaaaagctgatggagcgtgaggacgacatcggattgatgatgcgttccgtacatgattccatcagttcatttgcaactgtgatttccggtatcaaaacagcaacagaagaattaaaatctgtatccgatgattttaataatatctttcatgatatggaagattccttgaagatcacacaggattcaacgcatacgatcgcagataacactgtgacgcaggcagcacagacggcagatatgaaagagaagatcgatgcgatcggcgatctgatcgctatgatttccgagaatgtcgatgccttgaatgcaagtgcagataagatgcaggaatgtaatgagtctgctgaaaatattatgggagaactgatcgacatcagtaagaagaatggggaagcgattgagaatgtaagagagcagtctaagcttaccaatgattctgcccagcagatccagacagttaccgatattattgcagatatttccaatcagaccaacctgcttgcattaaatgcaagtattgaggcagccagagcgggggaacacggaagagggtttgccgttgttgcagagcagatccgtactttggcagatcagtccagagaatctacggagcgtattaaccagcttgtagcagaccttatggataaggcaaatgtgagcgtggagatcactgagaaggtatccgaggcagtcagcctccagaatgagaagatcgatcagacaaaggagatctttacaatattgaacggtgagatcggtcaggtcggaagtgcgatcgaaggcatcagctctgaggtggaagaattaaagaatcacagtgataacattgagacggagacggtttccctgaaagaatttgcagctcagaatgcggagagtgcacagatcacgatcgagcatatgaatgagttagacagcacagtcagcaagtgcaatgcagctacagaacgtgtggttggagtatctgataagctgatcggttatgtgcatgagacagaggacagaaagaaaatattaccaatcaaataatgcataaaatgaatattgcgttgtaaatacaacagaaaaataacgatgtttttattacaatctgtacatacctcgtaacaagcgctggtgtgcaggggtagccccctgtatatcagcgttttacattacaacatttcataaaaaggagattacacaatatggaacagaaaatgttttgttttcagtgtgaacagactgcgggatgcagtggatgtacaggaaatgcaggtgtgtgtggcaaatctgcaaatacagcaaaattacaggatgaactgaccggagcattgatcggtcttgcaaaatcctgtggaaataatcccaaaacagaaaataccgaccgtattatcatcgaaggtttatttacaacgatcacgaatgtgaatttcaatgatgagactttaaaagagatgatcgcaaaagtcaaagcagagaaaaataaaattgtaccggattgcagtgcctgtcagaatccatgtggcaacacagacgattatgacatgaacaatctgtggaatgacaatgaggatatccgctctttaaaatcactgattttatttggaatccgtggtatggcagcttacgcttaccatgcgatggtgttgggctacacttcggacgaagtgaacagcttcttttaccgcgcattatccgtgatcggttatgacatggatatggatcttctgcttccggtcgtactcgaagtgggagagaaaaatctgatctgtatggaacttttagataaggcaaacacggagacatttgggacaccgacaccaaccacagttccattgtccgtagaaaaaggcccatttattgtgatcactggacatgatctttatgacctgaaactgttattagagcagacaaaggataaaggaatcaatatttacacccacggagagatgctcccggcacatgcttatccggaattgaagaaatatccgcatttaaaaggaaattttggaactgcatggcagaaccagcagaaggaatttgatcatcttccggcaccaatcctttatacaacaaactgtctgatgccggtaaaaccaagctatgcagaccgtgtatttacgacagaggtggtttcttatcctgagatggttcacataggggaagaaaaagactttaccccggtcattgagaaagcattagaacttggcggctatgaagctgaccgtgagatgacagggatcaatggcggtaagacggtcatgaccggttttggacatggaaccgtgttaggagttgcaaatcaggtgatcgatgctgtgaaatccggagcaatcagccactttttcttagtgggtggctgtgatggagcaagagttggaagaaactactatacggaatttgtaaaacagacaccaaaggattctgtcattctcacgcttgcctgtggaaaataccgttttaatgaccttgatcttggaaccatcggcggacttccaagaattatggatatgggacagtgtaacgatgcttatagtgcaatcaaggttgcaattgcgctcgcagaagcgtttgactgcaacgtgaacgaacttccactttccatggtattgtcctggtatgagcagaaagcagtctgcattttactgacgttgttacaccttggtattaaaaatatttatcttggaccaactctgccggcgtttctttcaccgaatattttgaattatctggtagaaaattatcagatttctccgatcagcaccccggaggaagatctgaaaaaaatacttggctgattgaagtctgccatttgtattcgaacatagagtgtgctagaataaggttgttgcactgtgaaaagtgtgtcagtcttattctgcgtgtgtctgatggcagattttgcacaaaagagataaggcggaagttttatttgacagtacaagaggagatttttatggaaaaagagacagaaaaacagaatcttgggagtggcagcattcccggtttaatgataaaactggcggtgcctacaattatcgcacagcttgtaaaccttctatataatttggttgaccgtatttatatcggacatatccgcgaggtgggggatattgcactgaccggactcgggttatgttttccggtacttatgatggttacggcatttgcaatgctcatcggttccggtggcgcaccgagagccgcaatttatatgggaaaaggggacaatgagacagcggagcgtattcttggaaacagtgtgacaagcctgatcgtaatctcggttgtgctgaccatctttctggaagcagtcgcggagccgattctgtggatgtttggcgcgagtgagaaaaccttgccatttgcattgggatatatgcggatctatgtggcggggagtatttttgtcatgatgacgctgggattgaatatgtttatcacaacacagggatttgcaaagatcagtatgaagacagttctgatcggagcaatttgcaatatcattcttgatcctttatttatttttgcatttcatatgggcgtaaagggcgcggccgttgcaacgattctctcacaggcagtttccgccgtgtgggtgttttcttttttgaatggaaaacagacaaaacttcgtatccgaaaagaatatttaaaagtacagccgcagatcattcttccggtcatgggacttggtctggcatcatttgtcatgaatattacggagagccttataaacattgcatttaatgcgtccctgtcgaaatacggcggagatgtggcagtgggagcgatgacgatccttgcaagtattatgcagttacagttcatgccggtgcaggggcttggacagggcgcacaaccgcttatcagctataactatggcgcggcaaaggttgaccgtgtgaaaaagacgattcgcattttgatcgtggtaagtctcatttacacgatggcattctggctgtttgtagagtgtttcccgggggtttttgtacagctgttcaacagcagttccccggaattgtatgagatgacgacgtgggctgcccggatttatatgggcatgaccggtatctttggaatccagatggcaatccagcagacgtttatgtcgcttggacaggcaaaactttccttattcattgcatgtttaagaaaaatcatcttgttgctcccactgatctatctgatgccgatgttcattgagaacaaagtgtttgcagtgtttttagcagagcctgtttcggactttatttcggttgcagtggcttccacactgtttttatgtaatataaaaaagattctggcaaaggcgtaagaatatgacaaaagatctgacacaggggaaaattactccattacttgtaaaatttacgataccacttttatttggaaacatttttcagttgatgtataactcagtggacagcattatcgtcggtcagcttgtgggaaaagaggcattggcggcggtcggcacaagcaatccattaatgacacttgcaattttgtttgtgaacggtatgtgtatcggggcttctattttgatgggaacccagtacggcgcaaagaaaatggatgttttaaagcggcagatcagcacgacgatgatcgcaggaattgtgttctccattacggtcacgttgttttgcattctttttgccagaccgttattattactgattcgggtgcaggaggaagtgcttccgcttgcagttccttatctgagaatcgtgtttttgggatttatttttacatttatctataatttttttgcatgcacattgcgggcgctgggagacagcacgacaccgctctattttcttgtggcaagctcggtgctcaatatcatcggggatttgtttttcgtggcagtgctcagatggggcagcatgggctgcgcggtcgcaacggtcgtcagcgaggcggtgtgttgtatgctttgcatcatttacattaagagaaaggtgccggagttaaatcttggaaaagcatggtttgtattcgatggaacgctgctgaaacagacgatcctctatggatggacgagtgcgatgcagcagggaaccgtgcagcttggaaaaatcggtgtgcaggcaattgccaacacaatgggagtttccgtgatggcggcgtatacgatcgtgaaccgcattgatgattttgcgtgccttccggaacagaatattgcgcactctatgacgtcttttatggctcagaacagcggagcaggaaaaaaagaacgtgtgcgaaagggattctggggcggtatgaagatcgaactggtttatggaatggtcatttttctggtgtgcttcttttttgcagagccggttgtgcgtttgttcgtcagagacacagatgttgtaaaagagggcgtcacttatctgaaactgatctcatttatgtatctgctcccggcagttacgaatggcatacagggatatttccggggaatcggagatctgaagatcactttgatcagtagtatggtgaatatgggagtgcgtgtgctcgcagcatttgtttttgtgtttggctttgcaatgaaggtagagacattcccgtttgcgtgtctggcaggatggattgccatgctgattacggaagtgcctcttttagtgcgcagttatgggtgtctgaagcgcggagagaatgctgtgatctaagacggatatacaggatattggacatgaatgacagggaaaaatgatggaagagaacagggcagaacaattgttttttttatgggaaaaaatttcagaaggagaaatccgtctgcttcgggtattcggagaacagccggtcgtgacagtgccgggatttatcgatggaagatgcgtgcgggaactgggcgattattgcttttcaagaagaaagcttccggagaatgagatccggtattcaaggtactgcggaggtatgtgggagagcggtctgtctgtgttgaaagacaaagagaaaaaggatcgtatttcctcagaacaggaagaaaatattatttctttggaaacaatagaacgggatggaaaactgcacgaattatcggaaaaatatatcaaagaggtacaacttccggcagacattgtgaaaataggaagctgtgcgttttataactgtacgaaaatggaaaggatcagtgtttatccaaaacttgtggaagtgggaagcgatgcgtttatgaattgcctgaatctgcgaagcttacggatgtgtgcaggggtagaggagccgaccggactaaaacagcttctcgcgcagatcaaatggcaggtggaagtatcgtttgaacaggaggacggagagagagaggcagttcttatgtatccggaatattatgagagctatgatgagatcggaccggcgcatatttttgaactgaatcttaccggagagggtttccgcgcaagacagtgctttaaggagggtgtcattttgctgaatgcctatgatgagattttcccacaggcgtgtgtggaggagtcagcggaagtgctcattccgatggcgtggaaccgtttatatgctgcatgtgggctgtcaccggaggcaagggcagcttatgagacttatgtgagggaacagtccgggaaggttttaaccattcttttaaagaaaagagagttaaaaccgttacatttcttctttgagaaaggatacggcaggaaagaacagatagaggatgccgttgcaatcgcatcgcatgaggaatggatggagggtgtggcaagcctcatcgcatggaagcggcagttatttgcagaaccagagaaaacggcggatgtgaagagccgctattcatttgaggaattttaataataaaggagctgacatggagcagtttaggagtaaacataagcagacacagagcgagtgggaggcagagatgtcgaagaaagttctggagtttgtgcgaagtgaactatatatggatctgcgttttttagatattgcactcggcacgcttgtttaccgggcggatgagaatatcagaagctttgcgactgacggcacatatctttatttttccacggagcaggtgttaagggtgtttcagagcaacccgaaatatctcgaccgggcatacctgcacagcgtgctgcactgtatctttttccatctctggatcggtggaaagagagaccgggaaaaatggaatcttgcctgcgatattgcggtggaatacacgatcgaccagatggacaaaccgagtacgaggcggatcttaagctggcagagacaaacggtttatgaagaactaaaacagcaaaaaagcgggatttccgcagcggttatttatcgttatctaagtggcagaaagccggcagaactgatcgcactgcaaaaggaattttacacggacgaccatcgttactggccgaaggaggaacagaaaaatgccgtaaatgaggacgccagaaaacagtgggataaaattgcaaggcagacgcgcatggaaaaggaatccagaggggatgagacagaggatggagaagatattcttgctgcacagctgaaggcagagaagagcagacaaagttatgcagattttctgcgtaaattttccgttctgcgggaggaactgcatgcggatcccgacgagttcgacctgaattattatacttatggattgcggctttacggaaacatgccgctcattgagccggtggagagccgggaggtcaaaaaaatccaggagtttgtcattgtggtcgatacgagttattcaaccagcggagaactcatccacaattttttgaaagagacctatacgatcctgaccgaacagaacagtttttttgcaaaaagcagaatacgcatcattcagtgtgacgatcaggtgcgcatggatgaggaggtaaaaaacagccgggaactcgaacagcttttaaatcgttttacagttataggtggcggcggaacagatttcagaccggcttttgcttatgtgaacgaattattagagcagggcgtgttgaaaaatcttggcgggctgttatattttacagatggcaagggcatttatccgaagaaacggccggaatataagaccgcatttctgtttctggatgattatgatgagagtgccgttccaccgtgggcaatgagactccgggtggaacaggaggatattttggcagaggagacaaggagaaaccatgaacattaaacaggcaaaagaagaaatcaaacataccgtgcaggcatatctgagcaaagatgcatttggcgaatataaaatcccggcggtcagacagcgtccggttctgttgatcggaccaccgggaatcggaaagacacagatcatggagcagattgccagagagtgtgagatcgggcttgtggcgtataccatcacccaccacacaaggcagagcgcagtaggacttccgtttattaaggaggagcagtacgacggaaaaacatattctgtgacggagtacaccatgagcgagattattgcgagtgtctaccgcaaaatcgaggagagcggcaggaaagagggaatcctttttattgacgagatcaactgcgtctctgagacgctggcaccgaccatgctgcaatttttgcagtgtaaaacgtttggcaaccaggcagtcccggagggatggatcattgccgcagccggaaatccgccggagtacaacaagtcggtgagagattttgatatggtaacgttagaccgtgtgcgctgcatgaatatcgaggcagaccttggcgtgtggaaggaatatgcaagagaaaaacgtttaaacagcgcaattttaagttatctggaacttcgtccgaagaatttctaccgcgtggaggcggacgtggacggattacagtttgtgaccgccagaggctgggaggatttaagcaatctcatggatgtctacgaggaacttgggattccggtggacgaggagatcattcatgagtttctgcggcatgaagatgtggcggaggatgtgtctgcctactttgatctgtataaaaaatatcaggacgattatggcattgcagagattttggagggaaaagtaaagccttccgtctatgcgcgtatcgatcaggcagcgtttgatgagaggctttcggtggtcaatctgctgctggatggtgtctcaaatgtcttttatcagatacagagagagcgtgagatcacggatgcatggtatgattttttgaaggaataccgtcaaaaattaaaaaattctttgcaggcaaaaggaatttttgaaacaattcttgcagaaaaaacagcgtcggatgagcagaacgagaaacagcagtttgtctcaaaaacacagagtgagctggcgcgcagcctgaacgaaaaattgaaggaatgtgcgaaaaagattgcagccggggaaacagataatatagaagaaacagcgttgtttgcactcgcaaaagcaccgtttgacgcacagtgtgaaaaactgcaaagccttgaaaatcaagggattgaaaccttagaacatgcatttacatttatggagcaggcattttcggatggacaggaaatggtagtttttgtgacagaacttacgatcacaccggagatcgcggtcttcttgagtgagcatcgcatagagcgttatgaaacatataaaaatcagctcttgatcggcacaaaacgcgcagaaattctgtctgagatcgcaagggattaagactgtttccagatttttttgggaaaaattaatggaagttgcataaaaataagcagaaaagctcacaataattgtaatatctgactgtttctgctttagcgcaaaaaagttataactgactcgttagtagattatttacacaaatggaaaaaatatatggtaaaattcgaagaaattttctcagcacagttcctgaatgagaaatttgacttttgggaataattgagtatgatagggttttgtaatgaagcggcagataaatttttggtttatctgtcgttttactatgttatgtatcattcttgaggaaaggagaaaaatgagaaaaaaaatattggacgcagcattactttttgctttcgcattgtgcttgattgttacgtccaacattcaggaagaggcagcatatgttgcagagcttgagaatgaggcagtaccgcttcaggatcaggaggcagagccggaagaaatgcaattttccgccggtgtggcagctgcaatttccgcaaattcatttaccacagaatcagatgaaaaaacaggtgttgaaaagaaagatgttgttttagtgacaacttcaaatgattcagaaagtaatttagaagaagagacagacggatcagttgaaacaaatacagaagtaagtgagagtggtcaggtggaggaagtttctggaacttcgcaggctccggcatacaacaatcgttggaacatcagcctgaccgatgaagagatcgatttgctggccaaaatcgtgtggctggaagcaaacggcgaacctgtcgaggggcaggaagcggttgtcgaggtggtgttaaaccgcatggcatccgatttgtatccggatacattatatgatgtgctgagccagaacaatccggttcagtttgtttcctggaaaagacgggataaagcgcatccgacagagacagagtaccagtctatttataatgtattaaatggaaatacagacctattaagaaatgatacaatgaatttttcaacttatccgctcacatcgaatcttgatgtaaaaatctgctgtcattatttctgctactaataaagtaccaggccatgacgcagccagcaaaagggatagtacatggataatttccgtgtgctgtcccttttctggattctgaaaatatgttaaaatatccgaaaaggcaaaatgattcaacagagggcaacacacccatgaatcattttttcatacagtaaattgcgaattgtaaaactcaacacagtgtaaatatattgtgaaaaattaatccgcgcaaaaaagacactggggagccgccggttcttagaaagcagtggctatatttcgttctgatttatcagataagaaatgcagccggtggtttcttagtaccgttgcgagcgacacgtagcggaagcgggtctctttatgcacggattaattttgaacaatttaaagacagtatagatgaattttacaattcgctacataacctaaggaaaaaataatcatgaaacaaattatagcaggaatcctggcacatgtggacgccggcaagaccacattgtcagaagcacttttatatagcagtggaagcattaaaaaaatagggcgcgtcgacaacggcgatacatttttagacacggatgcgatggagaagaaacgtggcatcacgattttttcaaagcaggcagaattacaatttggtgacacgaaaatgacacttttggacacaccgggacatgtggatttttcggcagagatggagcggacgctgatggtgcttgattacgccgtgcttgtcatcagcgcatctgacggagtgcaggctcatacacagacactctggcggcttttaaaacggtatgagatcccggtatttctttttatcaataaaatggatcagccgggaaccgacagagcggcaattcttttggagttaaaaaaacagttgtcggacggatgcattgatttcacggaacttggcgcaggaacagaagaagaagcacaggaaaacgagaaaagcagtactattatggaagaaattgccatggaagatgagactgcgatggaaagttttttagagaccggaaggattgccggtgaacaaatcagggaaatgatcgtgcagcgaaagatatttccgtgcttttttggttctgcgcttcggaatgccggcgtggatacatttttacaggggtttgaccgatatacgctggcaccggaatacccggatgaatttggcatgaaagtttttaagattgctagagatgaggcaaataaccggctgacgtatctgaaagtgaccggaggaacgttaaaagtgaaatcaccgctttcgaatgcagatcatgtgcggtttggtgaggaagtgtgggaacagaaagtgaaccagatccgcatttattccggaaccaaatatgagctgatcaatgaagcggatgccggaatggtgtgtgctgtgaccggattagaccacacatatccgggacagggatttggaatagaagcgcagggagaaacaccggtattagagccggtactgcatttccgtctgatcctcccggagggagtggagccggcagtcatgctgccaaaattgcgccagatcgaggaggaagagccggaattacatattgtatggaacgaaaagcttcaggagatccagatccagatcatgggcgaggtccagactgaaattttaaaaagcatgatcgcagagcgttttggcgtggaggtgtcatttggtccgggcaagattgtatacaaggaaacaatcgcagatacggtggagggcgtgggacattttgaaccgctcagacattatgcggaagtacatcttttgttagagccgctggaaccgggaagcggtattgtgatcgacacagactgcagtgaggatgtgctggataaaaactggcagcggctgatcgtgacacatttaaaagagcgggagcatatcggagtgttgaccggttcggtgatcacagatatgaaaatcacagtgatcggtggaagggcacacacgaaacacacggagggcggcgatttcagacaggcgacttaccgggcagtgcgccagggcttaaaacaggcgcagtctgtgctgctggagccgtattatgaatttcacatagctgttccgcagaatatggtaggacgtgctatgacggatgttgaaaagatgcacggaaagtttgaaggtccttatcaggagggcgatgcacaggttctgcgcggcattgctccggtggcgtgcatggcaaattaccagaaggaagtgactgcctacacgaaaggacttggaaaagtaacgttccggtttgcgggatattacccatgtcacaacacggaagaggtggtcgcacagaccggttatgatccgaagctggatttttcgaacccggcggattctgttttctgtgcgcacggagcaggatttatcgttccatggaatgaagtgccggatcacatgcatgtggaaggcaggctgctgaaaaagaaagagtggcaggaggaagcaccttccggtaaaaagacaaaaacctacgatccggatcactggatcgacattgaggagattgatgcgatcttagcacgtacctatcatgcaaataaacatgagaagggagcgacaaagcagtggcgcactgcgaaaaaagtgatctcgggagacaatgcgccacgctatgcacctgtaaaagcagtttccaaagaggaatatctgctggtggacggatataatatcatttttgcatgggagagcttaaaagagcttgcggcagtcaatatcgacggagcaagaggaaagcttttagacattttgtgcaattatcagggcataaaaaaatgcaatctgatcgtggtgtttgatgcgtaccgcgtaaaaggacaccagacggaaatgctcgatcaccataatatccatgtcgtgtatacaaaagaagcagagactgccgatgcttatattgaaaagtttgcacatgaaaacggaagaaaataccatgtgacagtggcgacttcggatggtcttgagcagatcatcatcaccgggcagggctgttatctgctctctgcaagagagtttgagcgtgaggtagaggcagcaaaccagacgcttcgggaaacaatcgatggaatgagggaaaaatcatccaatcacattctgggagatgcactgaaacaattaaccgatgagaaaatacaattgtaaaattcataaaaacggaattatgaaaatgaatcaatcacaggaaaaacaggacggagagaaattatgttaccagaacaattttgtgtgcgtatgaaagaaatgctcggagaggggtacgcagcattctatgcaagctatgatctgccgaaatatcaggcactcagaatcaatccactgaaaacagagcgggatacttttttgcagcaggcgccgttttctttaaacagagtgccgtggacaacgaatggctattattacagtgggaatgatcagcccggcagacatccgtatcatgaggcgggtgtttactatatccaggagccgagtgcaatggctccggcggagtatctgatggcggaaccgggagagcgcattttggatctgtgcgccgcaccgggaggtaagagcacgcagattgcatgttccatgcagggggaaggactgatcgtctgcaatgaaatccatccggcgagagcaaagatcctgtctgagaacatcgagcgcatgggcgtgtgcaatgcgcttgtgacaaatgagacaccacagaaactttcggataatttccgcgaatattttgaccgtattttagtggatgcaccgtgttccggtgagggaatgttccgcaagaacgaggatgcctgtgatgagtggagtccggaaaatgtagaaaactgtgccgcaagacaggcggagatcttagactgcgcagcggagatgttaaagccgggcggacggcttgtgtattcgacctgcacatttgccccggcggagaatgaaggcagtatcagccgttttttagagcgccacccggaattttcaatattaccggtggagaaaaaaggcggtatgatgccgggtgtgcaggcgtggacagagcatccggcggatggtttagaacacaccatccgtctgtggccgcaccatttaaaaggtgaagggcattacctcgctgtcttacagaaagcgggtgttttatctaaaacctgtcagggctattgcagaaacggtgtggagaagggaatcaatgagaaagagtgcagggaattttttgcatttgcagaggaaaaccttgtgaaaaatataacaggcaattttctgaaattcggcgaccagctttatcggatgccggagggaatgccgtccatccggaatctgaaagtgctccgcccgggactgcatctgggaaccttaaaaaagaaccgtttcgagccgtcccatgcactggcgttagcgttaagaccggatcaggtaaagcatgtgtgcaatttagagagtgacgacccacaggtcaaagcatacttaaatggacagaccctgaatatggacggagaaaagggctggtatttagtgactgtggatggttacagcattggctggggcaagttagccggtggcattttaaaaaatcattacccgaagggacttcgaaaaaatggctgatgggaaaacaggaaaaactttaaatttaacagagggtaatccgttaaaactgattttattatttgcaattcctgtctttttgggaagactgttccagatgatgtacagtctgatcgataccaagatcgtcggaagtattttaggggaagaggcattggcggcagttggctccgtgtcgatcctttataatcttctgaccggaattttcagcggctttacattgggattttccattgtgaccgcacagaactatggaagtgggaatgagaaacttttaaagaaaaatgtggcgtcttccataatactgggaatgatgacggcggttgtgatcatttttgcagtactgcttttcttaaatccgatccttcatgccatgaatgttccggaagaacagttttgcatggcacatgattatatcaggattttagtgtggggcatgtttgttacactggcatacaatctgtgtgcggatatgctccgggcgatcggggattccgtgacaccactgatctttctggtcattgcggcggtcacaaatattgtgcttgactatctctttatcggcggcttttccatgggcgtgtcaggagctgcctgtgcgacggtgctgtcacaactggtctcagcagtattatgctttctgcgtatcaagtccggtttcccaatccttcacatctcgaagaatgatctggagtgggacagagaacgcatgagacttctgtatcagaacggactggcgatggcactcatgtcatctctggtaaactgcggtactttgatcttgcagacgggaatcaataaacttggaacgaacattatcgtggcacatacagcggcgcgcaaagtgtttgagatattcagtcttccggtcagcgtttttggcgcctccatggcaacttactgtggacagaattacggagccggaaagtatgacaggatccggcagggcttaaaggcagtgcttggaatcggctgtgtgttcagtgtgattatttttattttatcgcatacgatatcaccgtatctgatctcttttattgcaagttcaaagaataaggaggtcatttactggggcacacagtatctggtgtacgatatgtcttttcaggtggtctgtgtgtttattgtgatcctgcgcaattcgttgcagggaatcggagatcagaggacgcccgtcttttcaagttttatagagctggcgggaaaagtggtgttcacgctggtttttgtgcgtaggtttggttattgggcagtcatctggacagaaccggtcatatggatctgcatggtgatcccactgatcgtgacggcagcaggaaacccggtattatttggaaaacaaaaataggagctttctatggagcgttggatatggtttctgggaatggcagtcttttatggagtgctgtttctatggtttttaaatcaggtgaaaaagccggattataagaaaaattatgtgcttgtaaagacactgcagagtgcagcgtttgtgtctgtgtttctggcagcagcagttgtcagtcgggatattctggatttctggctgatgcttccggcgtttgtctgctgctttgcaggagatgtaatacttgctttttataataagatcaaaaaaaagagactttttttgttgggacttgtcacatttttaatggggcatctgttctttatccggtggctggaccggatgcagccgccggcagttgcagatatggtgtttccggtcatagcggtgatcgggatttttgcagtgacaggaatgggcagctttcataccggaagacttcggccatgcattttagtctacactttttttattgcatacctgtttgcaaaaagcatgcatattgcagtgagtatccctgacatgcggcacatcgtctgtgcggtgggaagttttctgtttatgatctcagatatttccattctgtttctttatttttataaaaataagagccggaaagtccacctgtttaaccttaccacttattatgtgggaatttttcttctggcagtcagtccactgctttgcccatagggcagattctttgtcgaaaaatgttgtatcatgtttagaagatgccagataatgcatatttttgtgaaaaaaaacaaaaaaaacgcttttttatgtaaaaattatgtataatagctaaagagatgatacattatcgaatcaggaaggtacgaatcagatatgaacagacaactgacaatgctcattgtagatgacatggaagtggaacgcatttcgtttgcagaaatctttaaagacgaatatcagattctggaggcggaaaacgggaaacaggcgatggaacaactggaacaacaaaaggtacatattgttcttcttgatctttgcatgccggtgatggatggatttgaagtgatccgggagatgaaacagcaggataagtatgcggatatcccgatcgtcgcaaaaactgcaattgatgagaaaacagaggttaaagcgttagaagcgggagcggatgagtatattttttctccgtgtgatccggccatcgtgaaaaaaagagttcataatcttgtggaaaaatatattctggaacgggagaagatcagggcacagttagagaaagagcaggagatgggcagggcaaaagaactgtttcttgcaaggatgtcccatgaactccgcacaccgatcaatggaattctgggcatttcacagcttgcccattataaagatgcagaagtccgggaggattttaagaagatccgttaccaggcggagtatctgtgggaactggtcaatgatgtgctggatatggcagccattgacaatggaaaaatgacgatccgtcatgtggcgttttcactcaatgaggtcgtgtcggaggtctctagtcttttttattcccagtgcaggatgaaaaggatctatttttatttcagggttgacaatgtgacacatgaatatctgatcggagatgcaatccgtgtcaagcaggtgcttgtgaatctgctctcaaattcgtttaagtttaccgagaagggcggaaccattgaggtgtgcatgtctgagctggatgtggatgacagcaggacggttttacatattacagtgcgtgataccggatgtgggatttcggataaagctttggaaaaaatctgggaaccgtttgagcaggaacagcatgaaaacggaaaatattacggtggcagcggtctgggacttccaatcacaaagagcattgtcgaacagatgcacggaacgatcgatgtggcatccgaatataatgtgggttcaaaattcatcgtggacattccatttgaaattggaaaaagtattgtgcgggagaaacgtaagttcagatcattaaaagtttttctggtaaacaatgatgagatcgcactgcattatatgatgtcgacgctgacgagactcgggatccggtatgacagttcgacagacgggaaggagatcatccggatactcaaagaagcgtatgaacgaggggaaggctacgacatctgttttgtcaactggcagatgccgggtggattcggcaaaaaactggtcagggaaatgagagagatatttgaccgtgatacattaaaaatcgtcacatcttcctatgatacagaggattatgaggaagagatgcgcggggcgggtgtagattatatcctgaaaaaaccggtgctgcagtctcaggtatacagcatgatctcagagatctgcagcgtgccggaggcagagaaaaataaaacggaggactatgatttttccggaaagcgggcactgctggcggaggataatgcagtcaacgcagaggtctttcagggatttctgaaggctgtcaacgcagaagtagaatgtgccgacaatggggaagcggcactttcacgctatcagaatatgccggattactattatgacatgatttttatggatctgaatatgccgatcatggatgggtatgaggcagcaaagagtatccgaggcagcaaaaagccggacgcatcggatatcccgattctggcagtcactgcaaatgcgatggcaaaggatatcgtgaaagtgcatgaggcaggcatgaatgaaagaatcacaaagccggtacagagagagctgttgtatcagacaatggaaaaatatattctgtaagaaagggcaggagcacattgcgtgttcctgctttttatgcaataggaaatgtttgaaaagagagaagctgtgcttgacaacgaatccgtttctgtgataggttataagcagacactttaatgtggtagcgtggtaataaactgaaaataaaggatggagattttatgaagaaatttatggcattattacttgttgcagggatgacattgtcgctgacagcgtgtggaggttccactgatacagcaaaaacggatcaagcagacggaaaagatacatttactgttggatttgaccaggattttccgccgtttggttatgtgggggatgatggcgaatttacagggtttgacattgagatggcgacggagtgtgcagcgcgtatgggcaaaaagattgtgttacagccgatcgactgggatgcaaaggatatggagttagaagccggtacgatcgactgtatctggaatggatttacgatgaatggacgtgaagatcagtatacatggacagatccatatatggacaacagccaggtggttgtggtaaagaaagattccggaattaacacacttgcggatcttgcaggaaaagtggtggaggtacagaaagagtctgccgcagagaccgcattaaacgatgaagaacatgcagatctgatggcttcctttgcacagctcttatcggtaggcgaatacaacaccgcatttatggatcttgagtctggcgcagtcgatgctgttgcgatagatatcggtgtcgcacagttccagattgagggaaaagaagatcagtatcagattttagatgagacgatttcctcagaacagtatgcggttggatttttccttgggaacacagcacttcgcgatgaggtgcagagcactttattagagatggtagaggacggcacattcgcagaaatatccaaccaatatttcggttatgatgtctgcacgctcggcaaataacagcgcattggttttacagtagaaaaagataggggttctttttatatgagctttcaggtaatgatttcccagcttggttccgggatgatgacaacaattcagattttcttattaacacttattttttcactgccgcttggacttctggtagccttcggaagaatgtcaaaaaatgctgtgataagaacgatcaccaaaatatatatttccattatgcgtggaacacccttaatgctacagcttttggtggtatattttggaccatactatattttcggcgtgaatatttcgtcaagctaccgcgcatatgcggttgtgatcgcatttgcaatcaactatgctgcatattttgcagagatataccgtggtggtattgagtccatgccggttggacagtatgaggcggcaaaagtattaggctatggaaaaacacagacatttgtaaagatcatccttccacaggtgatcaagcgtattcttccgtccgtgaccaatgaggtgatcacgctggtaaaagacacgtcgcttgcgttttccattgcttatgccgagatgttttcacaggcaaaggcactggcagcttcacagaagagcatgatcccgtttgtggcagccgcgatattctattatgtctttaactatgtggtggcatttatcatggaattttttgagaaaaagatgagttattatcattagagatacaatcgtagtaaaattaaggcaaagaggaaatgatatgaatttactggaaatgcagcatgtaaaaaagggcttcggcgaaaacgaagttttaaaagatatcagtttaagcgttgcagagggcgaggttgtctccatcatcggaccttctggttctggaaaatccaccctgctgcgatgcgcgacactgttagagcagatggatgacggaagcttaacgtatatgggggaaaaggcggcagagagtatcaatggaaaaacggtttatgcgaaaccggcagatttgaaaaagatacagagacattttggactggtattccagaattttaacctgtttccacattattctgtcttaaaaaatatcattgatgccccggtcagtgttcagaagcggaaaaaagaagaggttgttgcagaagcaaaggtattactggagaagatgggattaagcggcagggaagatgcctatccatgtcagctttccggcggacagcagcagagggtatccattgcgcgggcacttgccatgcggccggaaatattattttttgatgaaccgacttccgcgctcgacccggaactgacgcttgagatcctaaaagtcatccgggagcttgcggaggagaaaatgacgatggtcattgtcacgcatgagatgaactttgcaaaagatgtgtcaaaccgtatgatctttatggataaaggtgtgatcgtggaggagacgacaccggagttattatttacttcgacaaatcagagaacgagggagttccttggaaaatatcatgacatggcgtagtggtcgcatgttttgtataaaaaatcatctgtcctgcatggaaaaaaatatttgacatcaaatgcgtggatcaatataataaagaacggtaaaaagatgtgagatgtaatgtgaatcataaactcacatctttttctatgctttgagaaatactagaagagaaaatggaggaacagtgatgcagaaaatctgggtatgtggtgcccgcggtcagattggccaggcagtgaatgatgttgtggataaattggaatttgaaatgttagatacagatgtggatgaccttgatgtgacggatacagatgaagtacttcgttttggcgagatgaaccgcccggacattatcatcaattgttccggtatgacggatatcagttcctgtgaggaaaatccttcgcaggcgtttaaagtaaatgcactgggagccagaaatctggcgatcgttgcagcaaaaatgcaggcaaaaatggtacagctttccacggatgatgtgtttgacggcaaaagcacagagccttacacagaatttgacattacaaatccgggaacggtttatggaaagtccaagcttgcgggggaaaactatgtgaaagaattcacaacaaaacattttatcgtgcggagcacctgggtgtatggaaagggacagaattttatcaatggtttcttaaaaaaagtggacgcaggcgagcagttatcgattgcctccgaccagtttggatcaccgacgagcgcaaacgaactggcaagatttttattacatctggtgcatacgagcgagtacggaacttatcatgcgacaaacaagggcgtgtgcagccgttatgcgtttgcacaggagattttgaaaatgacaggaaagacggcttccatgcagccggttccaactgtcatgtcggatttttccaaggtgagaccggcgtatgcggtactcgataattttattatgagcatggttccgatttatgatttcccagactggcaggattccctgagagaatatctggaagagaggggattatatcatgcagaatagagttcaaaagaagaaaaagataagccttaccacgatgatctttattgcgcttcttgcaggagctttggccggtgtgatcatcaactatctgattccatcgaactacgtggtggatgatatcattgtgcagggtgtcttttatattgtcggacagggatttatccgtctgatgcgtatgctcgtcgttccgcttgtattctgctccatcgtctgcggaagcatggcagtgggagatacgaaaaagcttggaagcgtcggtgtgaagacactaattttttatctgtgtacgacagcgcttgcgattaccgttgcgctgacgatcgccaatatttttaatccgggaaaaggacttgacatgtcacagatccaggtgacttccaccgtgagtgagacaacacagtccatgagcatgacagaaacactgttagacattatcccggtcaatatttttaattccttaagcgagggaaatatgctgcagatcattgtgtttgcattgatcctcggtgtgattctcgcaaacatgggagaccgtgttgacattgtgaagaacttctttggacagttcaatgatattatgatggaaatgacgatggctgtcatgaagcttgcaccgatcggagtgttctgcctgatcgcaaaaacatttgcagagatcggttttgaggtgttccttccattattaaaatatatgttctgcgttctgcttgcgcttgcagtacagtgttttgtggtttaccttggattgctgaaaatattttcgggactcaatccgtttattttcatcaaaaatttcttcccggttatggcatttgcattctcaacttcaacctcgaatgcaaccatcccgatgaatattgatacactcgcagaaaaaatgggcgtttcgaaaaggatttcatctttcacgatcccgctcggagcgaccattaacatggacggaacttcgatcatgcagggagttgcagttgtgttcaccgcacaggcgtttggaatccctcttgatatgatggattacctcactgtcattggaaccgcgacgcttgcctccatcggaaccgccggagtgccgagtgtgggactgatcacactgacgatggtatttaattctgtcggacttccaatcgaggggattgcactgatcatgggaattgaccggatcctggatatgacacgtaccgctgtcaacatcacaggggacgctgtctgtacgacgatcgttgcctcctggaataaggcggttgaccgcgatgtttattacagacgaaaataggggacggactgtttcaggcggtcacggaataattgcacaaaaaagtataagtgaaattgttactttgcacaaaaagcttatgtattacaataaaaacatcagaggtacttgtaattccatacattttcgatataatgtcttagatggttaaaaaattaacgaacaaaaacgagtgaggtatttacaatgtacgctgatgaaaatgtgatcaaaattaaacacgatgtactttatgaagtggcaaaacttgcatttgcaggtgagcttgaggagaagaaagactacattgcaaaccaattaatcccaggaccagcagcacagttccgctgctgcatctataaagagcgagagattatcagacagagagtcagactggcagaaggaaaagctcctggaccagtagatgacggtaatgtgatccaggtgatcagttctgcctgtgaagattgtccgatttccagttatacagtgacagaaaactgccagaactgtcttggaaaggcatgtatcaatgcatgtaaatttggtgcgatcgagccgggaagacttcgttcccacattgatccacagaaatgtaaagagtgtggcaaatgtgctcaggcctgtccgtacaatgcgatcgcacatttaaagagaccatgtaaattcagttgtccggtcaatgcaattacatatgacgagtacggaatctccgttatcgacgagaagaaatgtatccgttgtggaaaatgtatccacagctgtccattcggtgcgatcggatctaagacctatattgtaaatgtaattgaagcattaaaatccaataaaaaagtttatgcaatggcagctcctgcaacagagggacagttcggtgatgatatcacgatgaacagctggaagaaagcaatggaggcagttggttttgatggtttctttgaagtcggtctcggcggagatatgacagctgcttatgaggcagaagagtgggcagaagcttacaaagaaggcaagaagaaagtaacttcctgctgtcctgcatttgtcaatatggtaagacgtcattttccggagcttgcagacaatatttctaccacgatttctccgatggcagcagtatcccgcctgatcaaagcaaaagatccggaggcagttaccgtatttatcggaccatgtatcgctaagaaatccgaggtggtagaccagaagatcgaaggcaatgcagattatgtattaacttattctgagatccgtgccatcatgaaagcgaagagtgtggcattagaaccggatgagaacagctatcaggaatcttctgtatacggtaagagatttgccaatgcaggcggtgtgactgcagcagttcttcagagcttaaaagaatctgaagatgagattgatgcaaaggtatgcaagtgtaatggtgcagcagagtgtaagaaagcgctgttattaatgaaagccggaagattgccggaagacttcattgaaggtatggtatgtgaaggcggatgtgtcggcggaccaagtgcattcaacgatcagatctcttccaagaagaacagggatgcattgatcagcaatgcggatggacgcggaatccacgaaaacttaaagaattatgatatggacagtttctctatgcatcgtgaataatgttgattttacagggctcgcagcggttgttgcgggctctcttaattcatgacaatagaatgttcgcggagcgtgcattctattgttgttgaaattgcatattatttataaaaaatacaaaaaattaaaaaaattataaaaaagtgcttgcatttttctttttaccgtgttatattagacaagcacggttcgttggtcaagcggttaagacgccgccctctcacggcggaatcaggggttcgattcccctacgaactgctatagtcatgcgaggaagcatatttatatgcttccttttttgatgtacaaaaagacgatttgtaccttgcaaatcggtggaagagtgctatactaaagaaaataagcagttttgaaaaagttttgtgaaaactggggaagaacaaaggagaacatggggtttaaaaagtatcagaacaagattaacattattttttctgttgatatgtgtgggatgtctggcaattgcaatggcagtgtcttccattttcagcaggtctgctctgacagatacaaacgacagactgcatgagcagcaggcagagtattatgcgtctatgatcgacagctggcttcaggaaaatacaagtgatgtggatgcggcatgtacctttttggaggcaaagagcctgatcgatgaggtgacgatccgtccggttatggagcagtacacaaataataacgtgaatgcgatgaacgtcaatgtaggttttgaaaataagatgtttattgacggtactggctggaaaccggaagcaggatgggactgtacgggaagaccgtggtatacggatgcaaaagcggcaggcggagaaaagtattttggcgatccttatgtggatgcagtcactggagaattgatcatcagtgtgtctaagatgttccatacaggctccggcatggaaggtgtagtcaatatggatctgaagctgagcacattgtttgatatgatgaacgagatcaccgatacttcggatggcagttacagttttatttataatgaaaatggcgccattttaatgcatccgaacagtgagtttatatcaactggtgagaatgtagtgaatgtaagcgatctgatcggcggagcatacgagaaggcaatgacgtcccagagagcatttacggactatgacggcaaagccaaatacctgaaggctgccacagttgcaggaagcggatggaaagcggctttggtcacacctgttgcctcctataacagtgctgtgaacgaaatgcttatggttctcgttgtagttactgttttgtcagcagctatcgcagcggtacttgtgattttatatgccggaagcataacaaaaccgatcttgaagatccagaagcagatcaatcatttgcaggaactgaatttaaaggaaattgacatcaaggaaaacaggcagaaggatgagcttggaagaatgaaccatgatgtgctggaactgcagaagacactcggacatattatacagcagatgggcgactcctccacgaatttatcagagcagtatgatattgtgaattcttccgtttctactctgctggataataatgtttatgtcaagaacctgatcgatgaggtgctgtcagcagtcggtgaggaggcagaccagatccagacagccaatatgtcgttgaatgattttgcgaaagagatcgacgagatcacattgcacacagccaatctgaataaaagtgcgacgaggacaatggcacagagcgagacaggtgtcaaggcaatcgaactgctgggagagcagtttgaaaagacgagaaagcttcaggatgaagcatacagcacggtggccgatctggaagaacgctcgcgcacgatcgatgatatttcgcagacaatcaacagtattgcagagcagacgtccttattggcactgaatgcaagtattgaggctgcaagagccggagaagccggaaagggatttgctgttgttgcagaagaaatcggtaagcttgcacgtgcgaccagtgatgccactaccaacatcactgctattatcctggagatccagaaagaaattgaagtggtaagcagtcagatgttctccatgaaggatgagacagaaaagtgcatgggagttatgggtgatacccgtgccgtatttgaacagatcaatcaggagatcgatgatgttggcgcagatgttcagggactggaaggtgcagtaggacttttgaattcaaataaagcaaaagtagtggaccggttttcagatatttcttccgagacagaagaactggctgcatccagtcaggatattttaggaaaagttgaccagcagagcgtggagatggaaaatatccatactgcgatcgaaagcctgcacaatgttgtgacaaaactgaatgagatcatggatcagtttacagtgtaagccggtcaaagtagaaaaatgtaaaaaaatataaaataatgcttgcatttttgtttttgctatgttatattatgcaagcatggttcgttggtcaagcggttaagacgccgccctctcacggcggaatcaggggttcgattcccctacgaactgctctgttatttttataacagcccaacccggagtgccagaaacaatgtttctggcatttttaaatgctttttttaataaaaagcttgcaaaatagaagaaagagtgttactttatttatgttaacacgttgacttgattgagagagggcaaaaccctctctcaatttatgtttaggagacagcaacgtgacggaacacgaaaaaactgaatatggaaggaagaggtgtacacatgtcgaaaaaagagatgtatgaagcacgcaccgaagaactcatcaccccgattttagaccgaagaaactttgaacttgtggatgtggaatatgtcaaagagggtagtacctggtatttacgggtttacattgacaaagaaggcggaatcacttccgacgattgcgcagatgtatccagggaaatgaatgagattcttgacagagaggattatgtagaaggttcctatacctttgaagtgagctctccgggtattggaagaccactgaaaaaagaaaaagactatataagaagcatggggaaggaactggagatcagaacctaccgtgcgattgaccgggaaaaagaattttacggcattttaaaagcatacgatgccgatacagtgacaattgagcaggaagacggaaaagagatggtatttgaaaaatccaatatcgcactgatccgcctggcttttgatttttagcgtaaaataacagaaaaaataatggaggataaaataatggctaagaataatgaattgttagaagcgttaaatatattagaacaggaaaaaaatatcagcaaagagactttacttgaggcaatcgagaactcactgatcactgcatgcaagaaccattttggaaagtctgaaaacgtaaaagttaacattgatccggaaacatgtgaatatcatgtatttcaggagaaaaaagttgtagagaaagtggaagatccggttgaggagatcagcctcgtcaatgcgaagatgatcgactccaaatacgaactggatgacattgtaaatgtagaagtgaaatccaaagagttcggacgtatcgcaacacagaatgccaagaacgtgatcttacagaaaatccgtgaggaagagagaaaagttctttttgatgagtactacagcaaagagaaagatatcgtaacaggtatcgttcagcgttatgttggaaagaatgtgagcatcaacctcggtaaagtggatgccatcctcacagagaatgagcaggtaaaaggcgaggtattccagccaacagagcgaatcaaagtttatatcctggaagtaaaatctacctccaaaggaccgagagtgcttgtttccagaacacatccggaactggtaaaacgcctgttcgaatctgaagttgccgaagtaaaagacggaacagttgagatcaaggcaatcgcacgtgaggcaggaagcagaacaaagatcgcagtatggtctaatgatccggatgtagatccggttggagcatgtgtcggtatgaacggcgcgcgtgtcaatgccatcgtcaatgaactccgtggtgagaagatcgatatcatcacctggaatgaaaatcctgcaatgctcatcgaaaatgcattaagtcctgcaaaagttatttctgttatcgcagatgcagaagagaaagcagcaaaagtagtcgttcctgattatcagttatcccttgcgatcggcaaagaaggacagaatgcaagactggcagcaagactgacaggatttaagatcgatatcaagagtgagacacaggcgagagaagccggcgatttctttgattatgagaacgagtacgaagatgatgaatactatgacgaagatggtggctacaatgatgcagactatcaggatgacacagagtattccgaggagaattgatcgaggatagcagattatggcaaataaaaagattccgatgcgtcaatgcataggctgtggagagatgaagcctaagaaagaaatgataagagtcattaagacagcggaagatgagataatattagatacaaccggtcggaaaaatggcagaggtgcatacatttgcccggaaagcgaatgtctgcagaaagcaattaagtgtaagggattagaacgctcatttaaaatgccgattccaaaagatgtatacgaaatgctgacaaaggagatggaagaatttgagaccagataaagttttatccatgttgggaattgcagcaaaatccggtagtgtcgtaagtggtgagttttcaacggagaaagcagtcaaggaaggcagggcttatcttgtgatcgtggcaggagattcctccgataacacgaaaaagatgttttccaatatgaccgatttttatgaggttccaatgtatatttattctgacaaagagacattgggacactgtattggaaaagaatttcgtgcatcacttgcaattgtaaatgaagggcttgcccattccgtggaagacaaattgaaacagacaataacaactgaataatggaggagtcagaatatatggcaaaaatgagagttcatgaacttgcaaaagagttagagataaaatcacaggaaattatagatagtttaagcggtacagagtacgagatcaagtccgcaagcaacaacattgatgatgctgcgcaggagatcatccgtaaaaagtacaaaaaatccgcaccaaaggcagaagaaaaacctgccgcagagaaagcagaaaaaccagctgcaccaaaggcagaggagaaagcgagaccagaggagaagaaaccagcagatgctgagcatgacagaccaaagaaaaagtccagcatcacagccgtgtttaacgcacagtacagcaaacagggcgcaggacatggaaataacagaagaccgaaccagggagcaaaaggcggaaaatcacaggatggcagacgcccggcaaatgaccgtggtgacagaccggctggtcaggcaaaaccagcgatgtccggcaatgatatgagaaaatattttgacagtctgatcaatccaaatgcaggaaaagagacagaaaacaaagctccaaaagcagaggaagttaagactgaaactgcacagactgcaccggcagcacaggagagagttttcaaaaaaccaactgagaatgtttatgagcagatgcgtcagcaggagaagacctccagaccaaatcaggacaacagacgcccacagggagaccgcccggcaagaaacggacagaatggcggatacaataaccgcgcaaacggcgacagaccagcccgtccgcagggagaccgtccatacagaaataataatggcgaaggtggatataataaccgtaacaatggtgacagaccagcccgtcagggagataacagaggccagagaccaaacggcggaaaccagagaccgttcaacaacggaagaccgggacagggattcaatcagggagaccgcagcggaggacgcaataataacttccgcggaagagataatggtggaagattagaccgtgagatcgacaagttcaataaggattctgcaccattggcagaggagatgcgcggaaaagagacacgggagagagaacgtgacaacaagaaccgcaacggaaaacagcgcggcgattatgatgttttaggaagcaggaagcaggagcgcttcgtaaacttagagaagaatggcggcaagaagaaaccacagcagcagccacagccaaaacaggaagaagagactatcaagacactggtccttccggagaaacttaccatcaaagatcttgctgacaagatgaaagtacagccgtcagtgatcgtaaagaaattattcttaaaaggaacgatggtaacagtcaatcaagagatcgattacgatcaggccgaagagatcgctttagagtttaactgtatctgtgagccggaagagaaggttgatgtgatcgcagaactcttaaaagaggaagatgatgcagaagagacattagttgcacgtccaccggttgtatgtgttatgggtcacgttgaccacggtaaaacatcccttctggatgcaatccgttctacccgtgtgacggacagagaggcaggcggtatcacacagcatattggtgcttctgtggtatccatcaacggacagaagatcacattccttgatacacctggacatgaagccttcacagcaatgcgtatgcgtggtgcaaattctacagatatcgcaatccttgtagttgcggctgatgacggtgttatgccacagacggtagaggcgatcaatcatgcgaaagcagccggagttgaaattattgttgcgatcaacaagattgataaaccaagtgcaaacatcgagagagtaaaacaggagttgtccgagtatgaactgatcccggaagactggggtggaagtactattttctgtccggtatctgctcatacaaaagaaggtattgacaacttgctggagatgatccttttaacagcagaagtgcttgagttaaaagcaaatccaaaccgtaaagcaagaggtcttgtcatcgaggcacagcttgataaaggccgcggagcagttgccactgtattagtacagaaaggtacgttaagagtcggtgatccaatcgcctgcggaagctgctttggtaaagtccgtgcgatgatcgacgatcagggaagaagagtaaaagaggcaggtccatctactccggttgagatccttggtctgtccgctgtcccggaagcaggtgagacattcgtttctactgattctgagaaagaggcaagagcatttgctgacacttatatttccgagagcaagaataagctgatcgaagatacgaaggcaaagatgtccttagacgatctgttctcacagatccagtctggaaatgtaaaagaattgaatattattgtaaaagcagacgtacagggttctgtagaagcagtaaaacagagtcttgtaaaactgtccaacgaagaagtagttgtaaaagtcatccatggcggtgtaggtgcaatcaatgagtccgatatcatcttagcatccgcttccaatgcaattatcattggatttaacgttcgtccggatccaactgcaaaagtgacagcagacagagagaatgttgacgtacgtctctacaaagtcatttacaatgcaattgaagatgtggaagcagctatgaagggtatgttagatcctgtatatgaggagaaagtacttggtcatgcagaagtgagacagatcttcaaagcatccggtgttggtaacatcgcaggttcctatgtgcttgacggtgtgttccagagaggctgcaaagtccgtatttcacgtgaaggaacacagatctttgaaggaaatcttgcttccttaaagagatttaaagacgacgtaaaagaggtaaaagccggatacgagtgcggtcttgtatttgaaggatttaatgatattgctgagcttgatattgtggaagcatataccatggtagaggttcctagataaaaaagaggcataaaatatgagaaaaaacagtattaaaaataccaggatcaatggagaggttcagaaagaattaagtaacattatccgtggtgagatcaaagacccacgcattaatccactgacaagtgtagttgccgtggaggtggctccggatctgaaaacctgtaaggcatatatcagtgtcttaggagatgaaaaatcccagcaggatacgatcaaaggcttaaagagtgcagagggttatatcagaaccatgcttgcaaagagcattaacctgagaaacacaccacagatcacctttatcttagaccagtccattgaatatggtgtcaaaatgtcaaaaatgatcgatgatgtaacaaaagatatcgcagataagacagaggaatagagatgacaaattttgatgtttatctggcagatgcaaaaacagttgccattgcaggtcatgtcagaccggatggcgactgcgcaggctcctgcctcgctacatacaattatattaaaaactattttccacatgtgaaggtcgatctttacttagagccgatcccgaatattttcaagtttatgaagcgttcggaagagattttgagtgagtggccggatgacaggaaatatgatctgtttatcgcacaggactgcggtgatgcaaagcgtcttggcaatgctgcaaagtattttgaatcggcagaacatacgatctgtgtggatcatcatgtgagcaatcagaactttgcagaacataactatatttttccagatgcaagctccacctgtgaactgatctttgaactgcttccagacgagcgcattgaccgggagatcgcagaatgtatctacaccggaatggtgcatgataccggtgttttccagtattcctgcacttccagaaaaacgatggagatcgcaggaaagcttatcgaaaaaggaattaacttcccaaagatagtcgacgagacattctttacaaaaacgtataaccagaaccgtattatgggacttgccctgatgaaaagtgttctgcatctggacggaaagtgcatttccagtgtcatcacgaagcaggagatgcaagagtatgatgtgcttccaaagcacttagatgggattgtcagccagcttagggtgacaaaggatgtggaagttgccatattcctgtatgagttagaggatggagaatttaaggtcagcacaagatcaaaagaacttgttgacctgtcagagatcgcagtgaagtttgacggcggcggtcatgtgagagctgcaggtttttccatgaagggagaaccggagcagatcatcgaagctattttgcaagaagtgaaaaaacagctttaaaaaataatgaagaaaaaggatacactatggtcaacggaatcattaatgtatataaagaaaaagggtatacatcttttgatgtagtggcaaaactccgtggtatctttaaacagaaaaaaatcggacacacagggacactcgatccggatgcggaaggggtgttgcctgtgtgtcttggtaaagccacaaaagtctgtgatctgctcactgataaaagcaaagaatatgaggcagtgctcttattgggaaaggtgacagatacccaggatatcaccggtacagtgctggaggagaaagatgtgaaggtgacagaggaagccgtgagggagacagtcctttcttttgtgggggactatatgcagatcccaccgatgtactctgcgctgaaagtcaatggaaaaaaactctgtgatctcgcaagggagggcaaaaccgtagagcgtcaggcaagacctgtgaagattttaacgattgacattctggatgttacgcttccgagggtgcgcatgcgtgtacgctgttccaaaggaacgtatatccgcactttatgtcaggatatcggagaaaaacttggctgcggcggttgtatggaatcgctgctccgcacgcaggtgtctgagttcttgttaaaggatgccttaaaaatcggggagatcgagcaacttgtgaaggagtgcacaaaggaacttccgccggaagcatggagcagagcgcactttccgtttgtgcggtctgtggattctgtttttttacagtatcagaagggagtcgtgccggagcagttctctaaagtactgtataatggaaaccggatcgagccggagatgatccgctcgtttgaggcttctatgcagcaaaaaccaatcagaatttatgatgaaaaggatcactttatcggaatctatgaattccagcaggagaggggaaacttcaaacctgtgaaagtgtttatggaagaatgaaatatataaaaaatacactggattttcatgtcgaagaaccgactgtcatttctcttggaaagtttgatggtatccatcgcggacatgaactcttaatggaaaaacttgcgcagaaaaaggaggaaggattaaaggcagctatttttacctttgatattccaccgaaaaaaaatgtggagcatatcgaggcaaaggtgcttaccacgaacgaggagaaaatgcatatttttgaagggatcgggatagactatctcatcgaatgtccctttacgagagaagtgatgtgcatggaaccggaagattttatccgtatgctcgtagaaaaattaaatgtaaaatgtatcgtggcaggggaagattttcattttggacacaacagacgcggtgattatcagatgttgaaaaaatatgcaccggtctatggttatgaggcacttattctctcgaaaatgaaagaggatgagagggatatcagcagtacttttgtccgcgaagagatcatggctggaaacattgaaaaagccaatcatctcttaggctaccgctattttgtgaccggaatggtaaaacacgggaatcagatcggaaggacgatcgggattccgacgatcaatctgatcccaccggaggaaaaacttctgccgccttttggcgtctatgtgacagaagtgtttatcgatgataaaaggtattacggtgtcacaaatgtagggtgcaaacctacgataaagggaaataatccggtcggggtggagacacatcttctggattttagggaagatgtgtatgagaaagtggtaacggttgaatttcggacaatgatccgggaagaacgcaagtttgaaagtattgaaaaacttcaggaacagatgatgaatgacattgcatttacaagagcttttttcgcaaaaatgaaataggatgaatggacaggtaaatgccactttgtaaaatctggatctacaaatattacaaaaatgttacaaatatgattgacattgtaataagtgactgttatactgtaaaaagtttgaaaaatatattttgtaagatgaaaaagaagcagaaagacatgcagatgttcaggaggcattatgaaatccaaatatatcagagcaatatgtcttggagcagcaggattactagttatttccactgcagcgatcaacaatcataaacagagtgaagatgtgacagctaaggcagttgccacagcttctgtaatagaagaaagtgcagagacggtcgacgcaggtgtgacagccggtattgcaagcgtgacagcacaggcacttgccagtgatgaagacgtggcaactgtttctgatacagatacagaacttacagcagcagcacaggaggaagtgacatccgtatatggatatacgaatcttggaattgcagtggtagattccggtaacttaaatgtccgtgagacaccgggaaccgatgcagcgcttgtcggtaagatgccaaaccatgcagcctgcgaagtgttaggtgtggatggggaatggacacagatccagtccggggaagtcaccggatatgtaaagactgagtatctggtaaccggaaatgaggcggccgctctggcagagcaggtaaaagagacggttgccaaagtaacaacgacaactctttacgtgagggaagagcccaatacagactgcagtatcgtgacttctatgccaatgggtgaggagttagaggttgtagagcagttagatggctgggtaaaagtaagtatcgacagtgatgagggatatgtatccgcagactatatcgagatcaatacggaacttccgacagctatgactatgacggaagtaagatatggacagggagtctcggatgtccgtgtggatctggtatcttatgcatgccagttcgtaggaaatccttatgtgtggggtggtacaagcctgacaagaggcgctgactgttccggttttgtcatgagtgtatttgcaaactatggtgtttcactgccacattcttctggttcgcaggcaggctgcggaacaagcatctctgcatcggaagcacagccgggagatttgttcttctatggtaatggaagcaggatcaatcatgtggcgatctatattggaaacggacaggtggtacatgcaagttcccctcgtaccggaatcaaaatctccggtgcatgctaccgtaatccggtaaaagtagtccgtgtattgcaggattaatctggcttaattacaaaatttttgtttacaaatacagaaagactgtgttatactattcaggcatgagtttagcccatattcggtgaatggacactccgacctttcgctgagtatcatgttttattgggtgattaagaataagaaggaggatcataacatgatcgcaaaagaaaagaaacaggaaattatcgctaaatacggtagaacagcaaatgatactggatctccagaggtacaggtagctcttttaacagcccgtatcacagagttaacagatcacttaaaagagaacccaaatgatcatcattccagaagaggtcttctgaaaatggtaggtcagagacgtggtttacttgcttacttaaagaaaatcgatatcgagagataccgtgcattgatcgacagcttaggcttaagaaagtaatagtaggtataagcagaatagagcggagttttcaccgctctatttttttgcttgtatattccgaatatttctagtacaataaaacgaggcagaagtctaaatacccgagaccactgaagggtacatggcggacaggcatgtatggttcagtagtttcggtacttctgttttagtcacacagtatgctgtggcgtatacaaaatttaaaggagagaaaacatgtataaaagtttttcaatggaacttgccggcagaactcttacggtagatatcggaagagtgtgtgcacaggcaaacggcgctgcattgatcaaatatggtgagacaactgtattatctactgtagtagcatcagacaagccaagagatggagtagatttcttcccattaagcgtagagttcgaggagaaaatgtacgcagtaggaaagattccaggcggtttcaataagagagagggaaaagcatctgagaatgcaatccttacttcccgcgttatcgaccgtccaatgagaccattattccctaaggattatcgtaacgatgttactttgaataacatggtaatgtccgtagatccagagtgccgccctgaggtggttggtatgatcggttctgcacttgtaacaaccatgtcagatatcccattcgatggaccatgtgccatgactcagatgggtatggtagacggtgagttcatcgtaaacccatcccagaaagtatgggatgaaggcgatttacagttaacagtcgcttctaccagaacaaaagttatcatgatcgaagccggagcaaatgaaatcccggaagagaaaatgatcgaagcaatctacaaatgccatgatgtaaaccagacaattatccagtttatggataagatcgttgcggaatgtggcaaaccaaaacatgaatacacaagctgtgcaatcccggatgagatgtttgctgcaatgaaagagattgtgactccggaagatatggagaacgcagttttcacggatgaaaaacagaaacgtgaagagaacatccgtgagatcacagataaattggcagaggcatttgccgataaggaagaatggcttgctgttttaggtgaggccgtttaccagtatcagaaaaagacagtacgtaagatgatcttaaaagatcacaaacgtccagatggccgtgcaatcaaccagatccgtccattggcagcagaagttgatctgattcctagagtacatggttctgcaatgtttacccgtggacagacacagatctgtgatgttgttacattggctccattatctgaagtacagaagattgatggacttgatgcaaatattacaacaaagagatatattcatcagtataatttccctgcatactctgtaggtgagacaaaagtatcccgtggcccgggacgtcgtgagattggacacggagcacttgctgagaaagcacttgttgcagtacttccttctgaggaggaattcccatatgcaatccgtgcggtatccgagacatttgagtctaacggttctacttccatggcatctacctgtgcatcctgtatggcacttatggctgcaggtgtaccaatcaaatccatggtagcaggtatctcctgtggtcttgtaacaggtgatacagatgatgattatatcgtacttacggatatccagggacttgaggacttcttcggagacatggactttaaagtaaccggtacccataaaggtatcacagcaatccagatggatattaagatccatggtctgacaagaccaatcgtagaggaggcaattgcaagaacacgtgaggcaagactttacattatggatgaagtaatgtccaaagcaatttcaaaacctcgtaaagaagttggtgcatacgctcctaagatcatccagattcagatcgatccaaataagatcggtgatgtggttggtcagaaaggtaagaccatcaacgagatcattgcccgcacagatgtcaagatcgacattacagatgagggtgcagtatctgtatgtggaacagacaaagagaagatggcggaagcaatcgacatgatcaagacgatcacaactgattttgaggaaggccagatcttcaccggaacagttgtaagcatcaaagagtttggtgcatttatcgagttcgctcctggaaaagaaggaatggtacacatttccaagatttccaaagagagaatcaatcgtgtagaagatgttcttacattaggtgataaagtaaccgttatctgccttggaaaagataagatgggaagaatcagcttctccatgaaagatgttccagagaacaactaataaacgaataaaatagaaaaaataatatgtgaggtgttttccaaaagtgttactttcggggaatacctcattttgtttgacaatagaatgttcgcggagcgtgcatgctattgttttggctttgtcactggaagtttctgattttcatatactgatagaaaaaaggataacatttatggatcgagtgaaacgtgtcattcattgtgaccgtgcatataaaatgggcttgaacggcaaaaatatcactgtggcggtcatggataccgggattgccccacatctggactttgaccagagaattttacattttgaggatttctgccagaagaaacttgcggcgtatgatgataatgggcatggaacacatgtcgcaggaatcattggcggcagtggactgatgtctaaggataagcgtggcgtgcggctgttaagcggggtggcgccaagggttcgttttgtggtactaaaagtattggaccggaaggggaacggagttaccagccatgtgttagagggaatggactggcttttacaaaacagggagaaatatcaggtgaaaattttaaatatttcagtcgggatgatggcaagtgcaggaaaaaatgagcaggagcagctgcttcacgctgtggacgaggcgtggaatcagggaatcatggtggtgacagcggcgggaaataatggcccaaaggaaaactctgtcacaattccgggaatttccagaaaagtgctgacggtcggaagctgggatgataatgtgacagaaacaggaaacagtgggagactgacaaaaaattacagcggattcgggccgacggaatgctgtatcgtgaaaccggaagtccttgcacctggaacaaatgtgaaaagctgcagtaaagatgcaaagggatatattgtgaaaagcggaacctcaatggctgcaccggtagtttccggagcgatcgcacttgcatatcagaaatacccggattatacgccgacagagatgaaacttaaactctatgaaagtgtatatccgagaggggagcagattggcagaaaatgctggggaatgctacatgtgaacaatcttgtagtttgacattttcattttctgatattagaataatcggaaaggggcgaagaatacagatgaaaaaaatagcacatttattattaggaagattttcaatcgttgcagtttccattattctccagtttttatggcttgtaatggtcatgtatcagttcagttatcagttcacatatgcaaatcttgcgatcaggacaatcgcaattattgtggtgctggtgatcgtaaaccgttggacgaatccggcaaataaactttcgtggacatttattatcctgttgtcccctgtgcttggactcttattatatatgatttttggcagatcaagtcttacgaagaaaacacaggaacgtatggattccgtgaaccgggaggtgagtgcatgcctttatcagacaccggagatcaaagaacagttagagagagaggatctttctgtttatcgtcagtccagatatatcaatgactgggcaggatttccgctttatcataatacgtccacaaaatattacagctgtggagaagagatgttcccggatatgcttgcagatctggaaaaggcagaacattttatttttctggaatattttatcgtagatcagggagtgatgtttgaccgcatcgtggaggtacttgagcaaaaaagcaaagagggtgtggatgtccggctgatttatgacgatatcggctgcatcaatacactgccgccaaaatattataaggtattgcaggcaaaaggcattaagtgtgcagcatttaacccattccgcccgatcatgtccgttgttatgaataaccgggatcaccggaagatttttgtggttgatggcaaggttggatttaccggaggaatcaatcttgcggatgaatatatcaatgtggcgtcacggtttggctactggaaagatacagggatccggttagcgggcgaagctgtgtggagtatgactgtgatgtttctggaaatgtggaattacatcaaccattcctctgaggattacaaacagttcatgccacaggtataccagaaagaaccttttgagggagacggctttgtacagccttatggtgatacaccgttggatcatgagacagtaggagagaatatttatctgaatattatcaaccatgcagagcggtatgtgtatatttttacgccgtatctgatcattgacaatgagatgctggtgagtttgtgcaacgctgcaaagcgtggtgtggatgtgcggatcgtgacaccgggaatcccggataagaaaatgattttccttttgacgcagtcccattatgaaccgctgctcaaatgtggtgtaaaaatttaccagtatacacctggttttattcatgccaagagttttctctgtgatgataagattggaactgtgggaagtatcaatctggattaccgcagtctgttcctgcattttgagtgtggtgtgtttatgtataaaacgaaagccttgatgcagttgaaagaggactgtatggatacttttgcggcttccgaggaaatgacattggaattctgcagaggtcagaatgtgttcattcgtattttccagggcatgatgcgtctgtttgcaccgttgctgtaaaatggtaacaaagggtggagagccggtgagaggtttctctgccctttgctttttgatacggtttatttacactttgttccggtaataattcgcagatttatggcaggtacatttgcagtgattccataaaataatctttgtagacagcggcggcaatatcctcgctgcataaaatgtcgaccgttccaagttccctgtcgcccagtttatagacagcgcgcccgatgacatcaccggatgcaaccggggcttccacagattccggcagttccagttctttagtgataccggagagatcggaaccgtctgtaaccacatattgaaatggggagcggtagcagagagagacttcatcggaaattcctttttttaatgggagtgcggcgagtgtgtcggtgttctcatccgaataaatccgacatttggaaaaaccgtaatttaaaagtgtggctgcatcggcaaaccggatcttaaaatccggggcggccatgacgactgcaatcagttccatgccgtcctttactgcggtggcggagacacagtactttgcaaggctcgtcgagccggtcttaagcccggttgcatactgatattgccggatcagcttgttggtgtttgtcagaccaaattcctccgaaccgcgtcttgtgacgtgcgtgatcgtatccatccagatggtagaataattatggatctgtgggtatttcgtggtcagctcgcgggacatcagggcaacatcataggcgcttgtcatatgtccgtcaacgtcaagaccacaacaatttacaaatgtagtgtcgttcatgccaagtcctttggcacgctcattcattttttctacgaaagcggcttcactgccgcagataaattcagccatggcaacgcatgcgtcattggcacttgcgatgctgatacatttgatcatggtgtcgacggtctgcgtttcattcggttccaaaaagacctgcgagccacccatgctggcagcgtattctgacacggtgacagtatcttctaaagaaatctgaccggattcgatcgcgtcaaaaatgagaattagcgtcatgattttcgtgatacttgcagggcggaggactgtatgggaatttttttcatacagaatcgttccggtagatgcttccatgagaagaacgctcggggcagacagattgagaacgtcagacgaatcagccgccggagtggattccgccggtgtctcggaaagaacaaaggttctctcaaaggaaaaaatgttttttgggagaatattgtcctgacacaaaaaatagtacggtgacaggagggaaaaactgcttccaaggagcaggtttgcagaaagaagggcagagcataacaggcgcatttgggatacctccgaaaattttgggtttcagtgtcacatatctgcaaaaaggcgcagcctgcgacgtttctacttcattttagccggagaacctgtacattatgcttgcttttttttcggtttccatataaaattgatacgttgcgatttacaaattaaattcttatggtttgtgtcatggcagaccggacgaaacattgcaaggaagttatcatatatggagctgacggtaaaacttcaggtgtttgaaggtccactggatctgcttttacatctgttggaaaaaaataaagtgaatatttatgatatcccgattgtagagatcacgaatcagtacatggaatatatcgcggagatgaagcggaatgacttaaatgtcatgagtgaatttctggtcatggctgccacgttgatcgatattaagtccaggatgctgcttccgaagaaagaatccgaggaggaagaggaggaagacccgagggcagaacttgtacagcagctgctggagtacaagatgtacaagtgcatggcttatgaactcagggacagacagatggatgcggagcaggtgttttttaaggaacctacgatcccaccggaggttgcagagtatgaggaaccggtagatcttgcagaattagtcggggatatgaatctggcaaagctcgatcagatttttaagtccattatgaaaaaacaggtggacaagattgacccggtgcgttcgaagtttggtaagatcgagaaggaagaagtttcactttcggataagatgctgtatgtggaggacttctgcaaaacacacagaaatttcagcttccgcaaccttctggaagcgcaggcgagcaaggtggaagtgattgttacttttttggcaatattagagctgatgaaggtgggaaagatttttatctcacaggaacacacttttgatgatattaagatagaatcgaaaatggccgcttaacaggtcttgacggcatagggaatagatgaatggaagaaaagaattatgaagcgattgtggaggcaatcctttttaccatgggagaatccgtggaactggaaaaaattgccgctgcattggaattagataaaaaagagacaaagaaaattattgagcatctcatgaaagaatatgagaagccgagcattggcatgaagatcatcgagctggacggagcctatcagatgtgcacgaaaagcgaaatgtatgagtacctgatacggattgctaagcagccgaaaaaacatgtgctcacagatgtacttttagagacactctccattattgcgtacaagcagccaatcacaaaggtggagattgagaagatccgcggtgtttcctgcgaccatgcggtcaacaagttagtcgagtacaatctggtgaaggaactcggcagattagatgcaccgggacgtccgcttttgtttggcacaacggaggagttcttaagaagctttggtgtgcagtccctggatgaactgccaatgttagatcaggttcagatcgaggagttcaagcaggaagcagaagaagagatgaaagtaaaactggatatataaggagaacagagcgcaaagagtcatgagtaactttttgcgctatttttgtttgtggaaaaacgtttttatttttgcaggacggatcatccaaaagcataccgtatttcatttctgcatatagatgggtgaagagaaaaaataggtttttggtttgaaaaaagtaattgcgattattatatgtctggtcattttgtttacatatccggcaaaaatattggcagcgcaggagccgccgaaagaaacggaactttttgcaaaggcggcagttttaatggatggcggttccgggcgcgttttatatagtaaaaacggatcagaagcacttgccaatgcgagtaccaccaaaatattaacctgcattattgcactggaaaactgtgatttagagcagatcgccgaggtgtctgtgcaggcagcgaaggcgccaaaagtgcatctgggtgcacccgcaggacagaaattccggatgaaagatctcatttacgcgatgatgctagagtcctttaatgactgtgcagtcgttatcgcagagcaggttgccggtacaacggagcatttttcaaagctgatgaatgactatgcaaaaaaaatcgggtgtaaggacactttttttataacacccaatggtctggacgcacagaaggacagtcagtttcaccacacgactgcggaagaccttgcgcggatcatgcgctactgcattaaggaatctccaaaggcagaccagtttttgaaaatcaccggggaggcagagtatacgtttacagatgtgagtggaaaatatgcctaccattgctacaaccataatgcatttttaaagatgatggacggggcagtttccgggaaaacaggatttacgggaaacgccggatactgttatgtgggtgcgctggagcaaaatggaaaaacatatattgtggcactgcttgcatgcggctggccgaacaatagaacttataaatggtcggatacgagaaaacttatggagtatgggcttgccgcttatgagcgctgcgatctggacgatatcgcactggacgggagcagatttgcaccggttcccgttgaacatgcacagggcggcagaatcggagaacaggtgtacatgaaactgcatgccgtcctgaaaaaagatctctcccacgtactgctcagagagggggaacaggtgacagtggagtatcggatcgcacaaaaactgagtgcaccggtaaaaaagggaagctgtgccggagtcatctattataaactgggcggcatggtattgcgggaatatcaggtggagaccacagaagatatggagaaactggattttgagtggtgcttaagacaggtgttaaaactcgctgtctgacaatatgtggtaaagatctggaaaaaattctgtcaaaaaattaacaatgcacttgaaaattgtttggaaaagaggtaatattatcatagcgaaatttgttaattttttatagatggagggctaaagaatgagtagtagtaatgatagcttggcaatgcagcgtattaccaagttagtcgatgagaacagttttatggaaatcggttctcttgtaacagcaagaaatacagactttaatcttgcagacacagacacaccatccgacggtgttatcacagggtatggtctgatcgatggcaatctggtatatgtttacagccaggatgcatccgtattaaacggaacaatcggtgagatgcatgcaaagaaaattgccaatgtatatgacatggcaatgaaaatgggcgcaccggtcatcggttttattgactgtgcaggtatgagattacaggagtctgtcgatgcattagacggatttggcaggatttatgccaaagagatcgaggcatccggtgtgattccacagatcagtgccgtatttggaaattgtggcggcggtcttgcagttgttccagctttatctgatttcgcttttatggaagcaaccaaggctaagatgttcatcaattccccaaatgcgatcgagggcaacagaattgaaaaatgcgatacatccgcagcaaaattccagagcgaagagacaggctgtgttgactatgccggcacagaggatgagatcctcgcacagatccgtgagttagtatccatgcttcctttaaataatgagggagatgtttacacagaggaatgtgaggatgatttaaaccgcgcatgtgcaagcatggatgttatgaagggtgatgcaagatatctcttaagcgagatttcagacggacatgccttctttgagacaaaagctgattacgcaaagaacatggtgacaggatttatcaaattaaatggtatgacggtcggtgcagttgcaaactgtacagagatccatgatgaagagggaaagacagcagagacttttgaggcagcgcttaccgtaaaaggatgcgagaaagcatctgagttcatccgtttctgtgatgctttcgagatccctgttttatctatcacaaatgtgacaggattcaaggcatgcatgtgtgcagaaaaaggtcttgcaaaggcacttgcccacatgacttctgcatttgcttctgcaacctgtccaaaagtaaacctgatcgcaggcgatgcttttggaagtgcttatgtgaccatgaactccaaatcgatcggagcagatttagtatatgcatggccggagaccaagatcggtatgatggatgcagaacttgcagctaaaattatgtatgcagacgcttccgcagatgttcttgctgagaaagcaaaagaatatgaaaaattacagtcaaatgtagtgactgccgcaagaagaggctatgttgatctgatcattgagcctgcagatacaagaaaatatcttgttgcagcatttgagatgctttacacaaaatgtgtatgcacaccggataagaaacatggaacaaaatagaaaggtgaagttatgaagaaaaaattatctttaatgctttgtctttgcatcatggtgctgacactcgcagcttgtggatccgctgatccgcaggatgttgactacggcggaatgagttactctgatctacagagcagcgcacagaacttggtaacttcaattgcagcatcttctgaggaggagttatctgcggcaattgagacaaatgagcagtatgcaaagcagtatgcaaaacagtatggaagagaatacacagaggcagaagcagtgatcagtcttttacagtcatggctggacacgacatctgatgtgggtacatttgttggtctgggtgagttctctattgataagacaagcgatactgttaccgttgaccagatcgtaaatttttctgagagagatgtggacgtaacattcgtctatgaatacaattatctgacagaagagattgagatgactgatgcaacagcagatatcgtgtatacattaggcgagaagttagaaaaggcagctctcaatactttgatgggaatgggaactgtattctgtgtattaatacttatcagtctgatcatttactgctttaagtttatttcaaaagttggtgctccgaagaaagaaactgcaaaaacagaagcaacaaaagcaccggcagttgagacagtaaatgaaaaccttacagatgaccttgaacttgtagctgttatttctgcagcgatcgcagcaagcgaaggaacatccacagattcttttgtcgttcgttctatccacagaagataaaagaaccagtcacaatatgaaataaaagatattgattacctttatgatcaggaggatttattaaatgaaaagctatacaattaccgtaaatggaaatgtttatgatgttacagtagaagagaacggaagcgtaagtgctccggcagcagcaccaagacgtgcagcagcaccagccgctccggcagcagctccaaaggcagcagcaccggcaggtggcgcaggaagcgttaagattgaggcaggagcagcaggaaaagtatttaagatcgaagcttctgtaggccaggcagtgaaaaaaggtgatgctgttctcgtattagagatcatgaaaatggaaacaccagttgttgcaccacaggatggtactgttgcaagtatcaatgtaaatgttggtgatatggtagaagcaggcgctttacttgctacattaaactagtattttaggaggataactatgagttattttatggagacaatggacaatctccttcaccagactgccttctttaacctgacagtcggaaatttcatcatgatccttgttgcctgtgtattcctttaccttgcaatcgccaaaggatttgaaccattgcttctggttccgatcgcatttggtatgctgcttgtaaatatctacccggatatttttgcagaaccggaaatgatgagcaatggtgtcggtggtttgttccattatttttacacgttagatgaatggtcgatcctgccttcactgatcttcctcggtgtaggtgcgatgacagactttggaccattgatcgcaaacccgatcagcttcctgcttggagcagcggcacagtttggtatctttggtgcatacttccttgcaattttattaggttttaatgataaagcagcagcggctgtttctatcatcggtggcgcagacggacctacttctattttccttgcaggaaaattaggacagtcaggcctaatgggaccaatcgcagtggcagcgtattcctacatggcgttagttccaattatccagcctccgatcatgaaattatttacaaccaaaaaagagcgtgcaatcaagatggagaacctgcgtccggtatcaaagctggagaggattttattccctatcgtggtaacaattgtggtgtgtctgatccttcctacaacagctccactggttggtatgttaatgcttggtaacttattccgcgaatccggagttgtccgtcagttatcagagacagcatccaatgcgttaatgtatatcgtagtaattttactcggtacatcagttggtgcttccacgagtgcagaggcattcttaaactggacaacgatcaaaatcgttatccttggtcttgtagcattcatgttcggtactgcggccggtgtattatttggtaaattattatgctggatcacaaggggcaagatcaatccactgattggttctgcaggtgtttctgccgttccaatggcagcccgtgtgtcacagaaagtcggagcagaagaagacccgacaaactttttacttatgcatgcaatgggaccaaacgttgccggtgttatcggtactgcagtagcagccggtgtattcatggcaatctttggaatttaggaggaatagaaaatcatggcagaagttgttaaaaaacctttaaaaataacagaaaccgttctgcgtgatgcgcatcagtccctgatcgcaacacgtatgacaacagaacagatgcttccgatcgttgataaaatggataaagtcggatacaacgctgttgagtgctggggtggtgctacattcgatgcatcccttcgtttcttaaaagaagatccatgggagcgtcttcgtaaattaagagatggattcaaaaatacaaaattacagatgttattccgtggacagaatatcttgggataccgtccttacgcagatgatgttgtagagtattttgtacagaaatctatcgcaaacggtattgatattatccgtatttttgactgtttaaacgatatccgtaatcttcagacagcagttacagcctgcaataaagagaacggacatgcgcaggttgcattatcttatacattaggtgatgcatatacactggaatactggatggatatggctaagagagtagaagatatgggagctaattctttatgtatcaaagatatggctggactgttagtcccttccaaagcaacagagttagttcaggctttgaaagattctacatctttaccaatcgaacttcatacacactatacttccggtgttgcttccatgacatacatgaaagcagtagaggcaggatgcgatatcattgatactgcaatctctcctttctctatgggaacaagccagcctgcaacagaagttatggtggaggcattcaagggaacagaatttgataccggtttagaccagaacttacttgcagagatcgctgattacttcagaccaatgagagaagaagcattagagagcggtttgatgaatacaaaagtacttggcgttaacattaagactttattataccaggtaccaggtggtatgttatccaacatggtttcccagttaaaagagcagcatgcagaggataaatacgaagaagtattaaaggagatcccaagagttcgtaaagacctcggtgagccacctcttgtaactccttcttcccagatcgttggtacgcaggcagtatttaacgtattgatgggtgaacgttacaaagttgctacaaaagagacaaaagacgttttacttggaaaatatggtcagactgtaaaacctttcaatccagaggttgttgacaaggttcttggcgaggataagaagaatgcaatcacatgcagatatgcagacttgcttgaacctgaattagacaagatcgaagctgagatgaaacagtggaaacagcaggatgaagacgtattaacctacgctttattcccacaggttgccacagacttctttaaatacagagaagctcagcagaaaaaagtagatgccacagtagcagatacaaagaacggagcatatccggtataagacaggacagaaaagaggctggttttcagcctcttttttcttgcaaaaaagttcctatttgctataattaaaatgttggaattttgaaaatgttccgaaagcagcagattctatgtaaaagctgccggacagaaattggataacaggatggggaactatgggtaatacgcgtgatctgagtaatcgtattaatgaatcttacagcagattaagcaagggacaaaagttattagctacatatatcacagataattatgataaggcagtttttctgacagccgccagattaggtgaagtagttggcgtcagtgaatcaaccgttgtgcgttttgcaacacatttgggatacaaagggtatccggaattccagaatgcattggaagaacttgtgagaaacaagctgaattcgatccagcgtatggaagtgacctatggaaggatcagccagtcgaaaatattggaatcggtcctgcactcggatgcggacaagatcaataccacgttggagaaaatcgatcaggaagcatttgagatcgcagtgaataccattttaaacgcaaagcacatttatattattggaatccggagctgtgcgccgttagcatcctttatggcattctattttaacctgatgtttgataatgtgcatttacttcagaccagcagctccagtgagatttttgaacagatggtccggattggaaaggatgatgtgattatcgggatcagtttcccacgctattccatgcggactttaaaggcaatggaatttgcaaataaccgcaatgcaaaagtaatcacattgacagacagtgtacattccccgatgaatctgtattcctcctgcaatctgattgcggacagtgatatggcttcgatcgtggattctctggtagcaccgctcagtgtcatcaatgcgctgatcgttgcactttgcatgaagaaccgcaaaaaagttgcaaaaacactggagatgctggaagatatctgggatgaatatcaggtatatgagagtgatgagatcaattatattgatgactccattaaaatgcgatatggaaaaataggagataccgaatttaatgagtagagtagttgtgatcggcggaggacctgccggaatgtctgcggcaatcgctgcagcagaaaatggtcatcatgtaacattattggaaaaaaatgagaaactgggaaagaagctttttatcacaggaaaaggccggtgtaatattaccaattccagtgatatggatgtactttttaacagtgtcatgaccaatcggaagtttttatacagtgcattttacgcatatgataaccagatggtcattgatttttttgaacaggctgggctgccggtaaaaaatgaacgcggaaaccgcattttcccggtttcagatcattcttcggacgtgatcgcagcactgcagcgtgtattaaaaaaagatcaggtggagatcagacttcacagtgaagtggacacattattatatgaagattccggggaagaggaacaaaaaaaggtatgtggtgtgcggctttctgacggagagaaaatccaggcggatgacgtgatcgttgccaccggaggcttttcctaccagacaacaggatcgaccggggatggctaccgctttgcaaaagaggcaggacatactgtgacggagataagaccttcccttgtgccgtttaacgcaaaagaagactatgtcagggagatgcagggactttctttaaaaaatgtcaatgtccgtatttaccgtggaaagaaggtactttacgatgaattcggagaaatgctatttacgcattttggcgtcagcggaccattgattctgactgcaagtgcgatgatcaggccggatatcgcaaaagagcctcttgcaatggagatcgacttaaagccggcattgacggaagaacagttagacaagcgtgtgttgaaagattttgaggaagcaaagaacaaacagttcaaaaattccattggaaagcttttcccggcaaaaatgatcccggtcatgattgaattatccgggatcgatccggataaaaaagtaaacgagatcacaaaagaggagcgactgaaatttgtgcggctcatcaaggcttttccgttaacgttaaatggactgcgtgattttaatgaggcaattatcacaaaaggcggtgtcaaagtcagtgaggtgaatccatcgacgatggagtcaaaacttgtcagacatttatatttctgtggagaggtgttggatttagatgctgtgacaggtggtttcaatctccagatcgcatggtctaccggacatctcgccgggatgtgtgtggaatagaaaaatcgttactggaacgagtgaacagtaatgaaaaacagataaaaatgagaggaatggatatattatgagtatgaatattgcaatcgacgggccagccggagctggaaaaagtacaatcgcaaaaaaactggcaaaggagcttggttttatctatgtagataccggtgcgatgtaccgtgccatggcatattatttcctgacaaacggaatcgcctcttcggatgaaacaaaaattgcggaagcatgtccgaatgtggatgtgaccattgcctatgaaaataatgaacagcaggttattttaaatggtaaaaatgtaaacggatttatccgtacggaggaagtcggtaatatggcttctgcgacaagcgtatatccggttgtccgtaccaaattagtggaactgcagagaaagcttgcagagagcacggacgttatcatggacgggagagatatcggaacatgcgtgcttccaaatgcgcaggtgaagatttatctgaccgcaagttctaagacaagagcgcagagaagatacgatgaattgactgcaaaaggtgttttctgtgactttgatgagatcgagaaggatatcatcgaccgtgattaccgggatatgcaccgtgagacttctccgttgaaacaggcagaggatgcggttttggtagattcttctgagatgaatatcgatcaggtggtggaggcaatccgctctatttatgaagagaaaaaaggctgttaacaggaaaacggctgagagaagcaggaatcagaaaacgaatagataaggaatgatttatgaacattattttagcaaaaagtgccggtttttgttttggcgtaaaacgagccgtggaaacggtatacaaagaggcagaaaaaaatcagacaccgatctatacctttggaccgatcatccataatgaagaggttgttgcagatcttgaaaaaaaaggtgtgcaggtcatccattcgaccgatgaattaaagggcaggccaaagggaaccgtgatcataagatcacatggtgtggagagaaaaatctatgatgagatcaaggcactgggatttgagatcgtagatgcaacctgtccgtttgtgttgaaaattcaccgtcttgtggaacagtacagcagagaaggatatcatattattattattggaaatgagacacatccggaagtggaaggcattaaaggatggtctgatccagcggagacaaccgtgatcggaacatgtgaggaggcggaaaaatttacgctttcatccgaaaaaaaagtgtgtattgtatcacaaacgacatttaattacaataaatttcaagaattagttgaaattgtgaacgaaaaaggttatgatattattgttttaaatactatctgcaatgctacagaggaaagacagactgaagcagaacgtattgcaaaagaagtcgatgccatgatcgtcattggcggcagggctagttctaatacgcagaagttatttgaaatctgtaaaaaagaatgtgaaaatacttactatatacaaacaataaaggatcttgatttgaccagattaaaatccaccgataacgtaggtattaccgcaggggcatctaccccaaacaatattattgaggaggttcaaaagaatgtcagaaatgagttttgaacaaatgttggaggaatcatttaaaacaataagaaatggagaggtagttgaaggtaccgttatcgatgtgaaacctgatgagatcgttttaaatatcggatacaaatcagacggaatcatcactcgcaatgagtatacaaacgagtctaacgcagatcttacaactatggtttctgttggtgatacaatggaagcaaaagtattaaaagtaaacgatggcgagggacaggttctcttaacttacaaacgtctcgctgctgaaaaaggaagcaagagattagaggaagctttcgagaacaaagaagttttaacagcaaaagtttcccaggtattagatggcggtttatgtgttgttgttgatgagacaagagtattcatcccggcaagccttgtatctgattcttatgagaaagatctttccaaatacaaagatcaggaaatccagttcgtgatcagcgagttcaatccaaaacgcagaagaatcatcggtgacagaaaacagttattagttgagaagaaattagagcagcagaaagaactgtttgcaaaaatcaaagttggcgatgtcatggaaggaactgttaagaatgtaacagacttcggtgcattcattgatttaggtggagcagacggattacttcatatttctgagatgtcctggggcagagtagaaagtcctaagaaagtatttaatgttggagatactgtaaaagtattcatcaaagatatcaacgatacaaagatcgcactcagcatgaaattcccttctgagaatccatggaacggagcagcagagaagtttgcagttggtaacatcgtaaaaggaaaagttgcaagaatgacagattttggtgcattcgttgagcttgctccaggtgttgatgcattacttcatgtttcccagatctccaaggatcatgtagaaaaaccggctgatgtattaaagatcggacaggaaatcgaagcaaaagtggtagatttcaatgaagatgacaagaagatcagcttatcaatcaaagccttagaggcaccggaagaggatgctgtagaagctgctgaagttcatacagaggaataatatgcttgataattatgaaaaattcaaaaaagatgtatatgtgttaactaagatcgatctgaactgttataaggaaaaacagatgcgtcgtagaatagatacgcttattaataagaatgggatcacttcctatgatgcatatgtggacctgatcaaaaaggataaggaaaaattcgaacagttcgtcaactttttgaccatcaatgtctctgaattttatcgtaatccggagcagtggaagatcttagagggggaggtattcccaaaactgatcaaaacctatgggaaaaatctgaaagtctggagtgcagcatgttctacaggagacgaaccatattctctagttatggcgttgtcgagacagataccacttgctaatatcaaagtaattgctacagatattgacaagcaggttttggataaagcaagaatgggactctacaatgagaagagtattgcgaatgttccgaaggatctaaaggataaatacttcaagaaaattggaacatcctatcagatctcagatgagatcaaacgcagggtggaattcaaagaacacaatctgctgaaagatccatatccgactggctgtaatctgatcgtatgtagaaatgttgtgatctactttaccgaggaagccaaggatgagatttataaaaagttcaatcagtgcatgacaaagggaggagttctctttatcggaagcacagaacagattatgaattataaggaacttggatttgtccgggataaatctttcttctttgaaaaagaataatagaattacaaaggcgaaaaaaccatcacaaaaggttttttcgtctttttctgtattgcagtggtgagagaccaaattctttccgaaaagcatccccaaaatagttcccatcattaaaaccacagcggatggcaatctctgtcacgttcaggctggtatgtgtcaataattctgtggcctcgtagaggcgtgtctttgtcaggtattctttaaaacctaccccggtaatttgtttgaattttttggaataataagttggactcatatgtacataatctgcgaccatatgcagagatacaggttcctgaaaatgcgtggatatataacgggcggatgcctgaatggcattttctgcggaatcgagatcctgcagctgtatgtgatctctgtttcttacaagcagtgagagaatcagagaaatataagcgggaatcacagcttgactacaggtgtcctgtttggtggtttcctgatgcagggtatcaaataagcgggtggcattgtcctgaagcagagaagtaagatgaagcacaggataatgaaataaatgctccaggatatcctttgtatcagaatgaaaaagcgaagcggcaaagtccattgtgaaaaataaattgtagcgttttactgtcgaattgcagtcatacacaaaacgatgcatggtggattgcggaatcagaacaaaatctcccggaaccaggtggtaaatagaatgatcgatcagtgcactgcagtttccggaaagcagaaaataaatctcgtaatatggatggtagtgaaatcgatccatatgaaaatcagcatcgcgttctgcaaagtcaattttgtaatctttgattttatctgataaaagaatctcttccatgaaatttctccttttgaaagtatatggcaaaaaatcagtaaaaaataaaataacagcatataaaaacagtatgaatacttattttaaagttatatcatggaactatagaaaaagtaaagttatttacatgaggagaagatgaaatgaacgttgctttatcggaaaaggatcggaaattccgggaatttgcactggaaggatctatgtggaaagtgatttggaaagtatgctatccacttgcaatttatcagagcctgaaccagctttttaaaatactggacacgatgatggcggcgcacatcagtgcaaatgcagtgtcaacggtcgcatatctgtcacagatcaacatggcgatttctgctctgggcggtggacttgcggttggagcgagcattaagatcagtgaagcctatggagaaggaaattttgaactggtcaaaagacgtgtgagcacactttttgctttatgtggattgcttggcatggcaattattgcaattttgatcccggttgctccgcaatttttacgactggcgaatacgccggaagaatttatcgaggaggggactgtctattttattctggaactagtcagtcttgtcatcatcttttttaataatgtgtatatcgcaattgagcgggcaagaggaaattccaaacgcatcttaaatttgaatatgatggtgatcggaattaaattgtcactgactgctttctttgtttatgtgttaaaaggtgggattaattatatttcgattgcgacgattgtttcacagctggcgctgctcggtgtcgcagtgttttatatgaatgcaaaagaaaatgttttcggcttttcctggaaggcaatttcattccgaaaatcggtagtcgcgcctatgataaaactttctgttccggtgatcgttgaaaaaatggcattttcactgggaaaagttgtagtcaattccatgagtaccgtctatggtacactcacagtcggggcactcggaatatcaaacaatattggaggcattacgacaaatccacagaatggatttcaggagggtgcttctgcaatcatcagccagaatcttggtgcaggaaagaaaaagagggcgttgaaggctttctggtgtgtgcttgtcatgaaccttatcctcagtgtgatactgatgtcggcttccctgctctgcctgcatcagattgcagatctgtttgcaaatggagatcatgaatttgcgggcaggatcatggaaatatacagaatggaagtattaggaacgattcctcttggcgcgagcgctgcggtcatggcatttttgtatggatatggaaaaacaaaactgacactgcttttgaatttctccagagtgtttgtttttcgaattccggtgttatggggactgcagcatttcacagatctcggcaacgtgagcgcaggcattgtgatggcagtcagcaatattatgaccgcggtgatgtctttggttatatttgcgattgagttctgccagatccaaaaagaagaaaggacagacgcagagcaaagctaatgttttgcggcaagaaaatggcggaaaacatgactggtatactggcgcagaagagaatcagaatccagaaactcccgggtcagttcaaaataagtgagcttgtccttgtttgattctttgaaaaaaggcgtgatcaatgtttcgtattgtggaacaaagatagcgtctttttttgtgtaacagttgtcggcagttgcttttttacggaaatctttgtctacataggtggcgacacttttgtggattgccatatcttctgccgtaagatagtagtaatcttccgggtgatcgaagaaaaacttcaatgtgccctcaaacagatgaatccgcaatttggactgcatgccatcacagatcagataaaatgcatccgtctggcaggagacacgctgtgggatcgggtattggttttgcagcgtgaggatcagctccttctgagggatgtcattgcagtctttgtaaatatttgtttctgtcgaattcacagtaaaagccccgtcaaaaagctttctgtaactgcggatggcaatcagtccggtcatgccaagcacatcttcgtaattgtgctgtttcagaaagaacattgcctgctcatcgggagtttttaaataattctggtaaacttcgatcagttcacctccggaaaaagtatcatttctggagagaccgaggaaacgttctatggttttctgtttgtagtctggcagtttgagcaaaaattttaagccagaaacttctttataaatatcaatatagtctttttcgtcaaaagggtgtgtaagaccatatttttcaaatttcttttttaaataaggaatatcaaatccaagtccgttgaaggagatgacggtctgatagtggcagagttcctgcagaaaggcagagagaatcgcgccttcctcctcttttgtctcggcgaaatactgtgtaatgataaaattgtcacccacacggtgcgcacagcctatcaggtagaggaaagtataggcgggagagaaaccggtcgtttcaatatcaaagaaaaatgcgtcttctgtgaatgtttcatttaaaattaaatttgtatcggtaagatggtgtgttttgttccagattttcataggtatatcgtttcctttatcgtgttttccaccacagtttaccatatccggcgaaaagaatacatagattttattatgtaaaaattatttatatattctaaaaaatatgtatattattgttaaaaacttgtcaaaaggttctaaaaaaaatacaaaaaaaacatatttcatctgagagagctgtgttataatcatgctgatgatattttgtgattctagcgcaaaatataatactaaataagagaaagcggggcacaaaaatgggtttaaagacatttaaaggtggcgtccatccttatgaaggaaaggaactggcaaaagatcagccaatcaaggaagttttacctaagggcgatctggtttatccggtatcccagcatatcggcgcaccagcaaatccaattgtagcgaaaggtgataccgtattaagaggtcagaagattgcagaagcaggaggttttgtttcttctccaatctacgcatctgtatccggtaccgtaaaagccattgaaccacgccgtgtagcggttggagatatggtgaattccattgtcattgagaatgatggagagtataaggaagctgagttcactccatgtgaggatgtgacagctctttccaaggaagaaatcattaacaaagtaaaagaagcaggcgttgtcggaatgggtggtgccggtttcccaactcatgtaaaactctctccaaaggagccggagaagattgagtacattatcgcaaactgcgcagagtgtgagccatatctgacggctgactatcgcagaatgcttgaaaatccggaagagttagttgccggaatgaagattattttacagatctttgataaagcaaaaggtgtgttcggtgttgaaaataataaaccggactgtatcgcaaaattacaggagttaaccaaagacgaaccacgtatggaagtctgtccattacagacaaagtacccacagggtggtgagcgtcagttgatctacgctgttacaggaagagcaatcaactccaaaatgttacctgctgatgcaggatgtatcgtagataacgtagagacaatcattgcaatctacaacgcagtaaaattaggaaaaccagttatgaaccgtgtatcaacaatcacaggtgatgcggttgcaaatcctggaaacttcttatattacattggaaccaactatgcagaattagtagaagctgccggtggattcaaagtacagccagagaagattatctccggtggacctatgatgggattctctatgttctccttagatatcccgacaaccaagacatcttcttccctgttgtgtttggcagaggatgaagttgcaaaagcagaaacatctccatgtattaactgtggacgttgcgtggaagcgtgtccggaacagttgatcccatccagacttgcaaagatggcagatcatggtgtagcagatgagtttgaaaaatggcatggactggaatgtatcgagtgcggaagctgtagtttcgcatgtcctgcaaaacgtcagttggcacagtccatcaagaccatgaaaaaacaggttcttgcagcaaagagaaaaaaataaacagacaataaagagagttttataagattttattgtgaaaaaaatacgaagaaagaggtggatcccgtgagtgatttatatcatgtttcatcatcaccacacgtacgctcgaaagacacaacaagcaaaattatgctttatgtgatcatggcattactgccaaccagtttgtttggtatttataactttggtatcagagcgttaattttaattttagtaactatcgcaagctgtgtagcctccgaatggatcttcaacaagatcgtacataaaaagaacagcatcgatgatttaagtgccgttgtaacaggtttacttcttgcattaaaccttccggcatcccttccttggtgggaagcagtcatcggcggtgtgttcgcaatcgtcattgttaagatgatgttcggtggacttggacagaacttcatgaacccggctctcggagcaagatgtttcttactgatcgcatttgcagcggatatgacaaacttcactgtaggcgcatactcaggagcaacaccacttgcacagatgagaaatggggaagcagtgaacaccatgagcatgctgatcggtaagacagcaggtacaatcggtgagacatctgcaatcgcaattttaattggagctattttcctgattttaatgggcgttatcgaccttagaatcccggcttcctatattattacatttgttgtattcattctgctgtttggtggacatggatttgacatgaactatgtgacagcacagctctgcggcggtggattaatgcttggtgcattcttcatggcgacagactatgttacatctccaatcacaccaagaggacagatcatttttggtatctgctgtggtatttttacaggactgttccgttgcttcggagccaatgcagaaggagtttcctttgcaattatcttaagcaacctcttagttcctatgatcgagaaatacacagtaccaaacgcttttggtgttgtgaaaacaaaacctgaaaaggaggcaaagtaaattatgaataaaaagatcgtacatgacgctttggttttattcgcatttacagtcgttcttggtttgatcctcggagttgtctatggaattaccaaaccttccattgatcaggtaaattacgaaaaaacacaggctgcctacaaacaggtatttgaagatgcagcatcttttgaggaatacagtgattttgatgcagacgcagcagcagcactcatgacagaaaaaggtttttctgaccagatcgacagtgtgaatacagcactcgatgcaagcggcaatgtgatcggttatgttttgaccgttacagcaaaagacgccagccaggcaagtattaccttctctgttggtatccagaatgatggcactgtaaatggctattctattacaaatatcgcagaaacacctggacttggtatgaaagcacaggaagaagctttctatagtcagttcgagggaaagaacgttgattcctttacagttgtaaaagcagcaccttcttctgacagtgagattgaatctatctcaggtgcaactatcacatccaaagctatggcaaacggtgtgaatgcttgcatcgcatacttccagaatgtattaggaggtacaaactaatgaacaaaaatgtagaacgtttatataatggtattatcaaagaaaacccgaccttcgttctgatgcttggaatgtgtcctactctggcggttacatcatctgctatcaacggacttggtatgggactttctacaactgtagtattggtattatccaacttattgatctcagcattccgtaaggtcattccaaacggtgtgcgtatgccggcttacattgtgatcgttgcttcactcgttacagttgtacagtttatgatgcaggcttatacaccaagtctttctgactctctgggtgtgtatattcctctgatcgttgtaaactgtatcatcttaggacgtgcggaaagctatgcctccaagaatccggttgttccttctatcttcgatggacttggtatggggcttggatttacacttggtctgacactgatcggtctgttccgtgaattgctcggtgcaggacagatttttggcgcacaggttctttctttaagctggttcacaccaatcacaatcttcgttatggcacctggtgcattccttgtacttgcatgtctggttgctgttatgaatattgtaagagctaagatggaagcaaaaggcaaaccacttgcaaaaccatccggatgtatcactggtgattgtgcaggatgtggaatgtctgcaacatgtaccggtaaaaaaccggaatcagcagctgctgagaaaacagagtaggaggatagatacagatgaaagaattaattttaattgcagtcggatctgcgattgtaaataacgttgtattaagccagttccttggtatctgtccattcttaggtgtatccaagaaaactgagaccgcagccggaatgggtggcgcagttgtattcgttattacaatttcatcttttgtaaccggattgatttataaatatattcttgcaaatgaatatctgttaagcaagggcattgaccttacttatttacagacgatcgtattcattcttgttatcgcagcattagtacagtttgtagagatgttcttaaagaaatccatgccagctttatacaagagcttgggtgtatacttaccactgatcacaacaaactgtgccgtattaggtgttgcacttacaaacgttaccaaagaatataatattcttcagggtgttgtaaatggttttgcaactgcatttggtttcctgatcgcaatcgtaattatggcaggacttcgtgagaagattgaatacaatgatattccaaagcctttccagggaacagcgatcgtattaattacagcatgtctgatgtcaatcgcatttatgggattctcaggaatgatttaggaggaaaaagacgatgaacattacagcaattatttttgcagccgttgtagtcggcggtgttggtattttaattggatttttccttggtgtttccggagaaaaattcaaagtagaagtagatgagagagaagtagccgttacagaggctcttcctggaaataactgtggtggttgtggatatgccggatgttccggacttgcagccgctatcgtaaaaggggaagctccagtcaatcagtgtccggttggtggagcacctgttgcagccaagattggtgagatcatgggtgtcaaagcagaggaaggcgagcgcaaagcagcatttgtaaaatgtgccggaacctgtgaaaaagcaaatcaggactatgagtacacaggagttcaggattgtgccgctatggcatttgttccaaatggtggaccaaaatcctgcaactacggatgtcttggatttggtaactgtgtgaaagcatgtccattcgatgcaatccatgtcgtagacggtgttgcagtcgttgacaaagatacttgtaaagcatgtggcaaatgtgttgctgcatgtccaaaacatctgatcgagcttttaccagtgagcgcaaaacatatcgtacagtgcagctccaaagacaaaggtaaagatgttatgaaggcatgttctgttggatgtattgcctgtcacttatgtgagaaaaactgcccatctgatgcagttcacgtagtggataatgttgcatacatcgatcaggagaaatgtacaaaatgcggtctctgtgctgagaagtgtccgaagaaaatcattctctaggataataagacagagcacaaatattagatttcaaagaacttgggaaaggttgctatgttaggtcagacttaatatagcaacctttttaagcttattatgacatatgaattattttagtcggattaaaatatgtactttgctgtggtaaatggaaaaagtattttgatatttggaacaagatatgttaaagttatatttgacgtgaagtttgaaaaacctatataattttgaaagcattgtgtattcaaacttcaccggaaaaaatggaagttacatagacaattgcgaaactcataaaaaactaacttgaatgtttttgttaatttctcacaatttaagaagattaagatgagtttcgcaattgcctatagacggtagcataaagaggggcaacatgaacgagaaagaatttgattttaccaagaaaaaaagagtagttgtaaaaatcggttcctcttctttaaacaggggagagaccggaaatctgaattttacgaagctagagcatcttgtgcgcgagctttgcgacatgagaaaccgcggaatggatgtatgtctggtaagttccggtgcgatcgcagtgggacgtcagacaatcggtctgaatgagagaccgaaggatatttcaacaaaacaggcatgtgcggcggttggtcaggcaagactcatgatgacatatcagagaatgtttgcagagtataaccagatcgcaggacagatcctgatgacaaaaaatacaatggtaaacccggtgtcgaggaaaaatgccaaaaacacatttgaagagttatttcggcttggagtgatcccaatcgtaaatgaaaatgatacggtttctacttatgaaatgcagtttggtgacaatgatacattgtcggctatcgtttcttcgctggtaggggcagatcttctgattttattatcggatattgatggactgtttacggatgatccgcataaaaatccggaggcaaaactgatcaaagtggttgataaaattgatgcaaaactgcttggaatggcaaaaggttctaccggaagtgatgtcggaaccggcggcatggcgacaaaattcaccgcagcaaagatcgcaacgctttccggcgcggatatggtgatcgcaaatggtgcagatgtatgcattttacatcatatcattgatgatgatttcacaggaacaatttttaaagccgataagagtgaaagctttcatatcgcagattttattatggagacaataggataatggaacagtcaaaaatcgacagaattaatgaattatacagaaaatcaaaagccgaaggactgaccgaggcagagaagaaggaacagacactgctgcgcaaggaatttgtggcggatgtgaagaaaaacctgacagcacagttgaacaatattgacattcaaaatgaggatggaacgatcgaaaaccttggtgaaaaatatggaaataaaccaaagaaactttcgtaaagagcatcttgccatacgaaatgccatgctgccgggagaagtggcagagaaaagcagcaccattgtaaagcgtctgctgcaatcggaatggtataaagatacgaaagaaatttttgcttattatccgttagggaacgaagtggattgccatgcattgtttttacaggcatgggcagatggaaaacggatcgcccttccaaggacgaaagaggaaaatcagatggattttttctatattgattctttgaagcagttggaagagggcacatttcatgtgatggaaccggtcaggggcagtgaaaaagcagatccgctacagcaaccagtcattgttccgggaagtgtatttggcagggacggcagccgttatgggtatggaaagggttattatgaccgcttttttgcaaaatacccaagactgaggcgatatgcagtctgttatgagcatcagttagaagaaacactgccaacagatcaacacgacatctatatgcatgatatttatacagaaagggaagtcatccaatgcttttggggcagtgaagccttacttgaaagctaaaggatggctttgtaagtggattacacttaagttaaaaacagattgggaaagggagtatagaatggaattattggaaatttgtaaacaggcaaaagcaattgcaccaaaaattggaatacttgatacaaacacgaaaaatcaggcacttcttgcagtagcagattttttagtgaaagaacaaaattccattttggatgccaacaaaattgatattgagaatggtaagaaaaatcatatgccggaagggctgcttgatcgtctgctcctgacagaagtgcggattgcgcagatggcggaaggactgcggcaggttgcagcgctggatgatccgatcggggaggtcctgggaatgaaaaaaagaccaaacggacttatgattggtcagaaacgagtaccgcttggcgttgtcggaattatttatgaggcaagaccaaacgtgacggctgatgcatttgccctttgctttaagactggaaatgttgtgattttaaagggtggcagtgatgcgattcattccaatattgcaatcgtggagacaatccgcaaagcacttgtaaaagagggacttccagagcaggcaattgctttgatcgaggatacatcgagagagacagcagcagcctttatgaaaatgaatgaatatgtggatgtactgattccaagaggcggagcagggctgatcaaagctgttgtaaatcaggcaacaatcccggtcattgaaacaggaaccggaaattgtcatatttttgtggatgagactgcggattttgatatggcaatggatattatattaaatgccaagacacagaggattggtgtgtgcaatgcatgtgaatcgcttgtcatccatgaaaaaattgcggatgcatttcttccaaaattaatggagcgtctcgcagagaaaaacgtggaagttcatggagacgaaaaagtgatgcagattgcagaggaaggctgcatgaaaaaagagctgcttgttcctgcaaccgaggaggactggggcagagagtatttagattacaaactttctgcgaagacagtttcctccattgatgaggctattgcccatatcaatcaatacaacacaggccattccgaggcaatcatcacaaacaattattccaatgcggagaagttcttaaatgagattgatgcagcatgtgtttatgtgaatgcctcgacacgttttacggacggatttgagttcggatttggtgcggagattggaatttccacacagaagctccatgcgagaggaccgatgggactgatcgccctgaccagcacaaaatatattatttacgggaatggacagatccggaaataaatgataaaatactgacttgcggtatgttctataaaaaaacagaacatatgtttgctaaagcgataaaagtatgctataatttaagaaaagataggataatacaatgaaagaaaagagaaacattaccattattgataaaaagcagattccttccgaggagccggcaagacagtattatttcatggatattgcaaaaaaatatgtggcagagttagcagagcagaagggagcaccgctcacattctgtgtgacgacgttcgggtgtcagatgaatgccagggattccgagaagttagtcggtattctggaaaaaatcggttatgtggaagcaccggatgaaaaggccgattttgtcatttataatacctgtactgttcgtgagaatgccaataataaggtttacggcagacttggttacttacatggctttaagaaaaagaacccatatatgatgatcggactctgcggatgtatgatgcaggagccaaccgttgttgaaaagatacagaacagttaccggtttgtggatctgatttttggaacccacaatatttataaatttgcagaactgattgtgacagcactggagtctgattccatgacaattgatatctggaaagatactgacaagattgtggaagaccttccggtcgagcggaagtattcctttaaatctggtgtgaatatcatgttcggctgcaataatttctgtagttactgtatcgttccttacgtgcgtggacgtgagcgaagccgtgagccgaaagagatcgtgcgtgagatcgaacatttagtgcaggacggcgttgtggaagtgatgctgctgggacagaatgtcaattcttatggcaggaatctggaacatccgatgacgtttgcacagcttttgcaggagattgaaaagatcgagggactggagcgtatccggtttatgacttcccatccgaaggatttatctgatgaattgatcgaagtgatgaagaattccaaaaaaatctgcaatcaccttcatttgccattgcagtctggaagcagccgcattttaaaaatcatgaaccgtcattatgacaaggaacattatctggaattagtggataagatcagggcggcagtgccggatattgcacttacaaccgatattatcgtaggtttcccgggagagaccgaggaagattttgaggagacgatggatgttgtgcgcagagtccgctatgacagtgcgtttacatttatatattccaagagaaccgggacaccggcagcgacaatggatgaccagattccggaagaggtgatcaaggaacgatttgaccgtctgctgcatgaggttcagacaatttctgctgagaaggcgggaaaacttacaggtcagacacttccggtattagttgaggaagtgaacggacaggatgcatctcttgtcaccggaaaactgactaataattcaacggtacatttcccgggaacggcggacatgatcggaacgatccagaatgttgtgcttgaggaatgtaaaggattctattacattggcagacttgcttaatgattcgtgaaagcaggataaaaaaggatgtatgcatatataaaaggaacattaaaagagacaggtgaagattatatcgtggtcgaggctggcgggatcgggtatcagatctttacgaccggtcagacctttcagtatcttccgtccatgggggaagaggtaaaagtttatacttatctgcatgtgcgggaggatgcgatgatcttatttggttttctcaccaaggatgatctgtttgtgttcagactcctgcttggagtgagcgggatcggaccgaagggcgcacttgcgatcctctctgtcatgacgacagatgacctccggtttgctgtgcttggcgatgatgcaaaggcaatcgcaaaagcaccgggtgtcggagcaaagacggcacagcgtctgattctggaattaaaagataaattgagccttgaggatgcgtttgaacagaagttagcgaagaatgacaacccggttcaaaacaaagccaaaggagccaagaatgaggccattgaggcactggttgcgctgggttattcctcctcagaggcattaaaagcattaaacggtattgagattacagatgataccgatgtggaagacatcttaaaggctgcattgaaaaatatggcttttatgtaaaaaaggacaggtaacatggaaaagagagtaatttccactcaggttcaggatgaggatattaaaattgaaaaaaatctaagaccgcagacgttagatgattacattggacagcagaaagccaagaagaatttaaaggtttatatcgaagcggcaaaacagcgtggagagtctttagatcatgtcctgttttttggacctccgggacttggcaagacaacgttggcgggcattattgcaaatgagatgggaactcacatgaagatcacttcgggacctgcaattggaaagccgggtgagatggcggcaatcttaagtaatttgcaggagggggatattctgttcgtggatgagattcatcgcttgaaccgtcaggtggaagaggtgctctatccggctatggaggattacgtgatcgatattatgatcggaaaaggggctaccgcacgttccatccgtcttgaccttccgaagtttacactggtaggggcaacgacaagggcaggtcttttgtctgcaccgctccgggacagatttggtgtgatccatcatcttgaattttacacggtggatgaattgaaaaccattattatccattcggcagagaagttaggtgttgagattgacgaggatggagcctacgagcttgcgagaagatcaagaggaacacctcgtcttgcaaatcggctgttaaaacgcgtcagagattttgcggaagtgaaatatgacggaaagatcacaaaagatgttgcttcttttgcgttagatcttttggaagtcgacaagtttggtcttgatcagaatgacaggaatatcctgatgacaattattgaaaagtttcagggaggaccggtgggactggatacactggcagcttccatcggggaggattccggaacgatcgaagatgtctacgagccgtatcttgtccagaacggttttgtgatccggacaccaaagggcagaatggtaacagatcttgcctatcagcattttggaattgaaaaatagtgcaagttgttattgcttttacaatatcttgcttatataatatataacatatactatagcttgtacgtatattgggaaaggcaaaagcctgccgggaggagatcgttatgtctgagaagtccagtgctgaagtgatcattggcggtaaagtttatactttaagcggctatgagggagaagaatacctacagaaagtagcggcttatatcaacaataaaataaatgagtttgattccatggaagactatcggagatttccaacggatatgaaggcaactctgttacagttgaatattgcggatgattattttaaggcaaaagcacaggtggagaagttagaacaggatattgagatgaaggatcgtgagatttataatctgaagcatgatctgatctcaaaccagattaaaactgagagcgatgagaagactctgacagaattgcaggctgagaataaagaacttctgttgagcaaagcaaaattagaggctgcgaacaaagaacttctgttaaacaaaacaaaactggaggcttctttagaggatgccctgcttggaaaagttcctggtgcaaagaagcacggagaagaaaagaacgcaaaaaaagaagaatagatacggggacgattttatcgtccctttttccttatagacaatgttcaggtttgaaaataaacaggtgaaaagatgaaaaaaaatcagttagaattattagcaccggccggttcgtatgatattttcagggcggtactaaatgcaggggcagacgctgtgtacgtgggtggcggacagttcggcgccagggcatatgccaataatttttccgaggaagaactgctccgtgcaattaacgaagcgcatattcatggaaaacaactctatcttaccgtaaatacgctgttgaaagaagaagagttagaagctcagttatatgactatctgcgcccatattatgagcagggattagatgccgtgatcgtgcaggatatgggggcttttcagtttatccgtgagtattttccgaaaatggatattcacacaagtacccagatgactatctgtaaccgctatggcgcagaaatgatgaaagagcttggcgcaacaagagtcgtgacagcgcgtgagatgtcgtttgcggagattaaggatattgccgatcatgtggatatcgagatcgaaagttttgtgcatggagcattgtgttactgttattccggacagtgtctgctcagcagtatgcttggaggcaggagcggaaaccgcggcagatgtgcgcagccatgcaggcttccctatgaagtttatgatgcgaagcggaaaaaaattgcctgtgagccatttgtgttaagcccgaaagatctctgcacgatcgaggatatcccaaagcttgcagagagcggtattttctcgtttaaaatcgaaggcagaatgaaacaggcagaatatgctgccggtgttgtgtctgtctatcgcaaatatatggatcgatatttcgaatatggtgcgaaagactatcatgtatccaaagaggatatgcaaaagctttatgactttggaaaccggagcggttttacgaaggggtattatgagaaacataatggaaaagatatgattacgttccagaaaccaaaccatgcaaaaggaaatgaagcgcttcaggagaaagtcagggaagatttctgccgtggtgaaataaaagaaaaaatcaatggaaatttaatattatcccaagattcgtctgctatactggacgtgacaatgggcgatcttcgttatacagcatgcggtgatgtggtacagcctgcattaaagcagcctttatccatggaaaaggtacgtgagaacatggagaaaacaggaaacacgccgtttgagtttgagaatcttaccattgcgatgagagatgccattttccttccgatgaaatccttaaaccagctcagaagagatgcgttagaaggactggaaaagctttgtgtggaacagttccgcagggaggtggaacaggtggatcgtgccggaatgaaggcacaggagagcaaagcaggtacatcagagaaatatttgtctgccctggcagagcagagatgtcagttacagccgcttttagagtcagaaatggtttctgatatttatctggatcagggctgctaccgcagaaagaacttgtgggaagaagtaaaagaggatgctgcaaaaattcatgtagcagggaaaaaggcatattatgtgtttccatctgtttttcggaaaaatgcctcggatttttatctgggatccctgaaaaaactgaacagctgttctgtggatggagtggtggtgaagagtctggatgcagtctggtttgtacacaggtatctgccgcagatgccaatgatcctggatcaggggctttatacttacaatcacagggcacaggaaatattgcgtgaattttgtccgatccgtatgacggcgccttacgaattaaaccgtggtgagctgaaaaagagggataatacagacagcgaggtggtactttatggatatctcccgttgatgacatcggcgcagtgtgtgcatgccaataccggaaaatgtgacacgacatctgtagtgacatatttaaaagaccgttatggaaaatttttcccggtcaaaaataactgtatggaatgttataataccatttataatacgacgccactgatgttgtttggctatgggaaagagctgcaaaaagcagatttttccaatttcagactgaattttacggtggagagtgaggaggaagtgcggcagatccttgcgatttatgagactgtattttatgagggaagaaaaaacctcgcagatgtgtaccagggggagtataccaatggtcattataaaagaggagtagagtaaaacatgacgaatcttatcatagaaatatcaaaatatttcatgatctttatgtttgctttttatacgtacgagtgctttgcggcatttcgtcagaaaatcaaaccggaacaaagagaacatattttaagcagacagtgcgcagcaatctttctgatccactttgatgcctttgcggtgatctatctggtgacggaggatatcagtatgctgattttttatgcggcgcaggcggtacttctggcgatgatacagacctgttatcaattgttttacagcagatcatcgagacttttgacgaacaatctgtgcatgcttttgacgatcgggtttatcatgctgacaaggctttcttttgacagcgccagaaaacaatattttatagcactggtgtcgatgatattttcgctcatcatcccggtattgatcaacagggttggatttgtgcggaaattatactggttatttgcaatcgttgggatcctggcgcttttggttgtgacgatcgccggaaatacaagttatggagctaaaatttcgctctccattgcaggaatttcgatccagccgagtgagttcgtaaaaattttatttgtattttttgtggcgggcatgttatatcaggatacttcttttcaacgtgtgtgtgtgacaacggtgatcgctgcgatccatgtgctgatccttgtggcatcccgcgacctcggtgcagcactgttgtttttcgtgacttatgtggtcatgctttatgttgcaacgaaaaaactgctttattttgcgggcggacttgccgccggaagcgcagcttctgtggtggcttaccatcttttttcccatatccgggtgagggtgagagcatggcagaatccgctggcatatatcgataaggagggataccagatctcgcagtcactgtttgccattggaacaggcggatggtttggaatgggattatatcagggtctgccggataaaataccggtcgtaaaacaggattttattttttcagcagtctcagaggaacttggcggtatttttgcactgtgcctgatcatggtatgttttagctgctttctgatgtttttaaatattgcgatgcagatgaaagatcagttttataaacttgtggcactcggacttggaacgatttatgcatttcaggtattcttgacgatcggaggcgtcacaaagtttattccgtctaccggagtgacacttccgcttgtgagttacggaggaagttccctgttaagttctatgatcatttttgcagtgattcagggattgtatattttgagacaggatgaaggagagataaatgcgtctaaaagcaggaaaaacagacaaaacagaaaaaagacaaccggattcgaaaacgcagacatcgaaaaactctcgtaaaaacaaccgggaatttacggtcattacctatgcagttcttgtactttttgtctgcatgatgggatattttgcatatttccagtttgtaaaaagtgaagattttatcaatagtccttataataaaagacaggatctttttgcaaggaaggtgacgcgaggcgaaattatttctgccgatggccacatactcgcagaaacgatcacagatacggatgggacagagacaagatattatccgtatgccaatatgtttgcgcatgtcgttggtttctctaccaacggaaagtccggactggaatcgattgccaattttaacctgctgcgctcccacactatgactttggagaaagtggtcaatgaacttcagggagagaagaacattggtgacaatgtggtgataacgttaaattatgatctgcaggatacggcatacgaggcattaggaaaatatgatggagccattgtcgtgatggagccatcgaccgggaaaatacttgccatggtgtcaaaaccggattacgatccaaataatatcgcagaagactgggatgaactgacagcagaagacagtgagagctctgtgctgctaaaccgtgcgacgcagggactttatccgccggggtctgtgtttaaaatttttacgacattggaatatgtacatgaaaacagtgattatgaagattactcctttgattgcaatggtaaattcacagagggggattctgtcattcactgttacaaaaacaagcgacacggacaggaagatctgatcggctcatttgccgattcctgtaattcttcgtttgcatcgttaggtcttactctggatccggattcttttacagagctgtgcgacagcatgctctttaatacgagccttccactcaggtttgaatcctcaaagagcagtttctcgctggatgcggatgcagatgtgtctacagtgttagagacgtctatcgggcagggaaaaacgctggtgacaccgatgcatatggcactcgttgtgtcagcgatcgccaatgacggagtgcttatgaacccttatctgatcgaccacacggaaaattataatggtatcgtggtagatgcatatgaaccgacagaatatggaacacttttgtcagcggaggatgcgtctttaatgcagacttttatgagggaagttgtggaggatggaacaggagagcgtcttctggggcagagctatgctgcctcaggaaaaacaggaacagcagagttttcaacgtcctcaaaggcttcccatgcatggtttgtgggttatgcccaccgtgaggacaaggaagatatcgcagttgcggttatagtggaagattccggatcaggcagtgagtatgcggttccaatcgcaaaaaagatttttgatgcatattatcagtaaatgggacaggaaagatatttcagtattggttgcatgaaaaaacgaaaagtattatacttataacaaaaaaccacatcaggaggtattgcaatgatcgaggcaacaagttgtggtggtgtggtaatattccggggtaagatacttctcttatataagaattataagaataaatatgagggctgggttcttccgaaaggaactgtggaagatggggaagaattcagggatactgcaactcgtgaagtgttagaagagacaggagcggcggcaagtatcattaagtatattggaaagagccagtatacgtttaccgtgccggaggataccgtggagaaggaagtacactggtatctgatgatggcagacagttattacagcaaaccacagcgtgaggaatattttgttgattccggatattacaaatatcatgaggcttatcatctgcttaaatttgcgaatgagaagcagattttagagaaagcttataatgaatatctggagttgaagaaaaacaatttgtggggcagccacaagtacttttaatgtgaggattcgcatgaaatggtatgacgatttatacgtaggcgagagcatcgtacataagacaaataagatcaaatggaaaattcgtcataatgcagggcagattaatatttacgtgatcactctggcatcaggtgagaagaatttattagatatcattccttcacatgaactgctgcagaagggctacccgaagaagcagttatatgtcattggattggcaaaaggatatgatgaggcagtggaagtcgctgcgtctgtgatcgatgaagtttaccgccagaccggggcattcgaggtagcttcatatctcagggaaaaaaggaggagaaaagcagaatgaccgccgtgttactcacaatcttaaaaatcattgggattgtgctgttggtgattcttggaatcatgctttttctgttggcagtcttattgtttgtaccggtacgttattccgtgaaaggaacagttgataacaatatcaccgcagagggcaaaataagctggttatgttcgatattccgatatgattttacgtttcaggagcaggaattgaacggcgaagtccggatatttggctttcgtccgaagaaaaaagagagaatatcggaagaagagctggaggaggaagctgttcctgaagtaaaagacggggtggaagaggttgtttctgatcttgtttccactgccggggaagaagataaatcggagaaaaatccgattaagccagaacaggatcaagaggtagattctcataagggcaggcagaacagaaaatcatccggtaaaaattcccaacaatccggaaaaaatattttcatgcggatgtgggataaaataaaaagcttcatgaaaaatataaaaaaatttttcatgagtatacgaaagaaactgaccggtttcaaagagttcgtagtaaaagtcaaagagattgtgacggacacgaaaaatcagtatgctgtgaggcgattgtgggaagaattattgtatctgctcaaacattttggctttcggaaaattcatacagaactgacgtttgcgttggctgatccggcatttaccggacaggtgttaggcgttttgtgtatgatgccgttcctttatcagtatgattttcatattttccctgattttgaatcagaatcgttttatatcaggggcagctatgatgtaaagggtagaatccagcttatctttttgctggttaccgcgattcgtttgcaggcagataaagatatccgaagttttcttaaaaagttgttagatcacagagaataaaattcatatacgaaaaaacaggtaaaatagaaaggtggtagttacaatgggagacaatagttttcatacaacagtagaatccttattcaagggaatggacagtttcattacaacaaaaacggtggtaggcgatgcaatccatatcggtgataccattattttaccattggtggatgtttcctttggcgtggcagccggagcgttcagccaggagaagaaaaataacggtgccggtggtatgggcggaaagatcacgccgagtgctgtgttagtcattcagaatggcacaaccaagcttgtcaatatcaagaatcaggatggtctcacgaaagtgctggatatggtgccggactttgtgaacaaattcacatcaaaaggtgagaaagagaatgttgtggaagaatcagaagatgattcagctgcaaagaaaactgcagcaaaagagatggagcagatcttaagtgattctgtcaataaagaggaagcgtaattcagaaaaatatctggaaaaaagaatagaggcatggataacataaaaggacatatattaatagtgatatatgtcttttttggtgccagaatgaaacgtatcataggctttgcgttattcttttttgggcttggaatgcttgcgatgtttctgattccaagcgatttctgtgggattttgattatgattggatgtatcctgcttggatactatctgttttgctgctgttagaagagcagtatatctgttttcatttgaaaattttctgaatcaggacaaaaaaagagaactgcaatgcagttctctacgtttcaagactaagctctctcaacttttccggatctcaaacaggaagcacatacatataattttctaggtgttccgttaactttgcagctaacacgtttgatgtttgatttccaaactctatttgatcttctatgtgaatggcttactttaattccgtaatgattgccttttccacaaactgcacaatttgccatttgctttgcacctcctcgcatctttctaagcctatatgtatgaacaggctcacaacatgatttattctatcagaaaaaaaaagatattgcaagtgaaaattaaaaaaaatataaaaaatgtaatttatgactatgaattttggaaaaaagcggttataatagacactaaactagcgttattatgtgtgagagagaaaactggtcagccagtggctttcttacaaatataaagaaaggcatggttaatgagtatgaatggacagatggagaccaaattaggtaaggttacgatagaccctgaagtaattgcattatatgcaggttctgttgcggtagagtgtttcggaatcgtaggcatggctgctgtcaatatgaaagacggactggtaaaattattgaagaaagattacctgacacatggtattaacgtgtctgtgaatgaagataataaaattacaatcgattttcatgtgatcgtttcttatggtgtgagcatcagtacagtgacagacaatctgatcgagacagtcagatacaaagtggaagagttcactggaatggagattgagaagattaacatttacgttgaaggcgtacgtgtaattgattaaggaggattttaaaagtggaagtcactacaataaatgctgaactttttgccagaatgtttctggcaggagctaacaacttagaggctaagaaggaatggatcaatgagctgaatgtattccctgttccagatggagataccggaaccaatatgtcaatgacaattatgtcagcagcaaaggaagttgcagcgattgaaaatccaaccatggcttcattggcaaaagcaatttcttccggatcattacgcggggcaagaggtaactctggtgttatcttatcccagttattccgtggttttacaaaggtgatcgcagaatatgatgaactgaccgtacagattctttcagatgcatttcagaagggaaccgagactgcatataaggcagttatgaaaccgaaagagggaacaatacttacggttgccaaaggaatgtctgataaagctgccgagttaggagaggagacagacgacctcgcatatttctgtgaggagatcatcaaagagggtgaccatgttctgagcaagacaccggatatgctcccggttttaaaacaggcaggcgttgtggattccggcggacagggcttaatgcaggtattaaaaggtgcatttgatgctcttatgggcaaagaagtggattacaaggttgagacagtttctacaggaagcagcagtcagggcacagcttctaatccttatattgacgcacaggcagagcaggagatcacctttacttactgcacacagtttttgatcatgttagagcatccgttcacggagaatcaggagacagagtttaagagttatttagagtccatcggtgattctatcgttgtagttgcagatgatgagatcgtgaaagtacatgtacataccaatgatccgggtatggcaatgcagagaggtcttacttacggaagccttacaactattattattgagaacatgcgtttagagcgtgatgagaagatttctgcaatgaaagaaaaagagatgcagaacactgcgaatgcagagaacgagattaaggcagcagagaaaaatgagccggaagttccagcagaggaaaaagaaatgggattcatttctgtaagcatcggagagggtatcaatgagattttccgtggactgggcgtggactatatcatcgaaggcggacagaccatgaacccaagtacagaagatatgctcaatgcgatcgagaaagtgaatgcgaagaatattttcattcttccgaataataaaaatattattatggcagcaaatcaggcagcttccctgacagaggataagaacattattgtaattcctaccaagacgattccacagggcattacagcacttgtcaattatattccggacagcacaccggaagacaatgcggagcgcatgggtgaggaaatccagctggtcaagaccggtcaggtgacttacgcagtccgtgatactgtgatcgatgacaaagaaatcaaacaggatgactacatgggaatcggtgacaagggaatcctttccgttggcacagacatggagaaaacggttcttgagatgatcggtgaaatgatcgatgaggattctgcaattttaagtatttactatggcgaggaaatgaacgaggattctgccaacgagattgcagaaaaagtggaagaggaatatccagatgtagaagtggaagtacattacggtggacagccaatttactattatgtgatttccgtagaataaaagtatgagattaaattcatccataaaagaagtgaaagggatcggcgataaaacagccggtctttttcttaaaataaatattgagacaatccgggatctgatttcctatttcccaagaacttatgtgcagttcccagagatcaaacgtcctgacgaagtggtggagggggagactgcggcagtcatagggcagatccggcagactccggttgtgaagagagtgcgcagcatgcagatcacggtgacttcgattgccggcatgggaaaacgcctggaactggtgtggtttcgtctaccatacattaaaaacagccttcatccgggcggaacttatgtgttttacggcaaggtacagcacaaaaacggaaggtttgtcatggagcagccggcaatttatacgccggaaaaatatgaggcgatggaacatttgctgcttccggtttacactttgccgaaaggattatcaaatcagcttatgctgaaagcagagcggtctgttttggaggaagaacatttattccgggattatctgccgacagaactgcgggaaaagcatcagctctgtgagtataattatgcaatcaaacagattcatttcccggacgatatggagacgttgatcgaggcaagaaaacggcttgtgtttgacgaactctttttatttatcttaaacctgcaatatcagaaagaaaaaaaggaaaaagagaaaaatcagttttctttccagtcggatgattttgtggagcagttgatcgaaaaactgccgtataagctcacaaatgcccagttgcgggcattgtcagaggtccgggcggacatgcggagcgactacgtcatgcagcgtctgattcagggagatgtcggttccggaaagacgatcattgcgtttttagcgatggcggacactgcgcacaatggctgtcagtctgcgattatggcaccgacggaggtgcttgcaagacagcattacgaatcatttctgagcatgtgtgagatatttggactggattttcctgtgattcttatcacgggttccatgactgcaaaacagaaaaagctggcatatcaggagattttagaccacccggatgcgctgattatcggaacacatgcactgatacaggaaaaggtgatttatcagaaccttgcgcttgtgatcacagacgagcagcaccggtttggcgtaaaacagcgtgaaatattttcagaaaaaggaacaaagccgcatattcttgtcatgagtgcgacaccgattccacggacgcttgccattattttatacggtgatctggacatttccgtggtggatgaagtacctgcaaaacgtctgccgatcaaaaactgtgtggttgacaccagataccgcccgaaggcgtatcagtttatcgaaaaagaggtggctgccggtcatcaggcgtatgtgatctgtccgttggtggaagaaagcgagaacatggaggcagagaatgtcacagactatgcgaagcgtctgaaagaggaactgccggatacgattgaaatcgggcttttacatgggcagatgaaacctgcacagaaaaatgacgttatggaacggtttgcagcaaatgagatacaggtgctcgtatcaactacagttgtagaagttggagtgaatgttccgaatgcaacggttatgatgatcgaaaatgcggaacattttggccttgcacagcttcaccagcttcgcgggcgtgtcggacgaggggatgcgcagtcatactgcattatggtcaattgcagcaactccaaggagtcacagaaacgtctggatattttgaatcaatccaacgatggctttaaaattgcaagtgaggatctgaaactgcgcggacccggggatttctttggcatccggcagtccggtgaaatgcagtttgcgcttgcggatatctatcaggatgcctatattatgcagcgcgcaagcgaggaagttgcggatattttaggaaaagacccggaactttccagcgaggatcataaaaacctgaaagactatctggaactgtttttggcagaccagagaaataaattaaatttataacgaatgaagcagtaaaaacttcataaaacacgtagaaagaaccctggatcatatcaatccaaggttcttttcttgttcagggaaattttattttcctgacatctgctgttcctgtgcttcaatcattttcttaaccatatagccgccgacggaaccattctgtctggaagttaagtcaccattgtaaccatcttttaatggtacaccgatctcgcctgctacctcatatttgaaacggtctaaggcactctttgcttctggaacggctgctctgttagatgaacgatttgacatagtaagtcctcctttgttttttaggtcttttttctgctctggtttattttaagaacattcaaaaatttctttttgtttgttcagtgatagtatgtgattttttatatggaatacacatgcagttttttgcaatagtgccaattatttctttaaaatatgtaagcgcttacaaaaatatatttacaaacaggagaacattgattatgatggatatagaaggtagacaattgcgaaactcatgaaaaactaaattgaattgtgaaaaattaacaaaagacatgaaagacattggggaaccgccggcacttagaaggcagatacaacggtaagttgtgtctggcttcttagtaccgttgcgagtgacacatagcgagagcgtgtcttgaatgtttttgttgattttgaacaattgaaagaagagtagatgagtttcgcaaacgcctagatatagaaggttaaaaaaggagaagaactatggatcaaatcgaaaagtatattgaggaactaatggaaaaaagtacaccggaccgtcccatatggaacatcgaaaaaatcatgcaggggttaaaatccacatggaattacattgatggatgtatgatcaaagcgattctggaaatgtatgcgatcacgaaagaggataaatacttgaaatttgcagatgattttattgactgcaaagtgaatgcagatgggacaattgaggggtatgatgtcaatgaattaaatattgataatgtgaatgcgggaaaaacactgtttgagctttttgacctgacaggaaaagaaaaatacagaaaagcaattgatcttgtttacagtcaggttgcacagatgccgcgcacgaaagaggggaacttctggcacaaaaatatctatccggatcaggtctggctggacgggctgtatatgtgtcagccgttttatatggaatatgagacccgttttcatgataaaaaaaattatgacgatattttccagcaattttttaatgttgaaaaaaatatgagagatccaaagaccggattatactatcatgcgtatgattcatccagagcaatgttctggtgcgacagagtcaccgggttgagtcagaacttctggctgcgcgcactgggctggttttccatggcactgctcgatacattagacaaaacagacgcatcggctgcaggagaatcttacgaaaaattaaaacaaatatttgtcgaactcatggatgctatgttaaaatatcaggatgagagcggtatgtggtatcaggtcgtgaatttcggcggtatggacaaaaactacctcgaaacaagtggaagctctattatggcatatgcacttttaaaaggtgtccgtcttggatttttgtcggaaagctatcgcgcatacggtgagaaggcttttcatggaatctgtgataactatctttccacggatgaaaatggaaacctccatttgggcggaatctgtctcgtggcaggcttaggcggcgcaaacagacggccgggaacctatgattattatatgtcagagccggttgtcaaagatgacgccaaaggtgtcggaccatttttgcttgcctatacagagatgctccgcctgaaaaaatagcacgccattttgaacactgtcactgcaaaactgctcattcgacaaatcagtatgaaggaagtagagtagaatgaaacgttattttgattttgacatgaatgattataaagacagaaaatgcaattttcattcgcacacagtgcgctgtcagcatgcagtgggagaagagcgggaatatgtcgaggaggcaattaaggaaggctttgaggtgatcggcttttccgaccattccccttatttattcaaaaatggatatgtctcaagaatccgcatgacaatgtcccagttggaggactacgtaaaaaccattgaggccttgaaaaaagaatatcgggaggatatcacgattttcctcgcactggaaatggaatattttccggggatttttgagccgacaattgaagaaattagacagtatccaatggattatctgcttttggcacagcattttttctatgaaaatgaaagttttatcagtgtaaggcaaaactggacggatgaaatgcatctgaaaagctatgtagatctgctgacaaatgcactggataccggatattttaatatggtggcacacccggatatcgtaaacttcaccggagatgaagcattgtatacaaagtacatgaaaaagcttgcagacagattaaaagacgagcagattccaattgaaattaatgtgaatggtttccgggagttgtgcaattatccagatcgcaggtttgtgaaacttggtgtggaaaatggaaatgaatttattataggtgtagacgcacacaatccggatgagtatcatgatctcgcttcttacaagggatgtatcaaaatggcagaagatttcggaggaaaggtattctggaaataaaaaaatcgtaggggttgtacccctgcgattttttaatccgaaaccagcgtcagccctgaaatatccggatggatggtaagggagtagtttgtgtagtacacgacaaatcccggcgcggccccgtttggtttcttgacattttttttctgtagataatcaatctccactttttcatcttcacgtcctttggagaaatatccggcaagcattccggcttcctcgaaaacgcggtccggcaattcttcattgttggattttacgatgacgtgggaacccggcattccttttgcatggaaccaccagtcatttccggttgcaaacttgaaagtgagttcatcgttctggtaattatttttcccaacataaatatcatagccgtcggaggagcggtagtggaacggcttgctcttgattttggcttttttatccgtctttttgcgcttgatatagccaaattcgatcagctcctctttgatctgtacgagatcatcttccgtcagggcaatgtctaaagccgtggagatactttcgagatgttcgatctccgtctttgtctcctccgtcagcttggtgagtgcctcataagtacgctttaatttgttgtatctgtcaaaatatttctgcgcgtttcccttggcgtctaactgagagtcgagcggaatggtgatcatctcgttggtgtaatagttcagtgcctctaacttctttgcaccttcctctaaaccatagccgtaggtgtggatcaactcgccgtataccttgtatttgtcccgcttttccgtgtccttcaactgcttttcctgcaactggtatttcttgcggttgcggtctagggcagtggaaacgatctttctcaaatcaacggatttctgccggattcttgtatacacatttttggaagcataatattcctccaaaacctgtgagatggaatcgaaattctttgcttcgtaatccgaaaactgtgtgagttcaacgcaggaaaaatcaatcggttcttttcccttaaaaataatgttcggtttgtaggtatgattttttacatcctctgcaatccatgtgagattgttaaataaatgctttttgccatcatcatccagcgagtcgaccggcatatctccgtcaatggaactgcggtggcagatttcggaggcaagcagaggacttaagcctgtaaaagaagagtagagagcctttgtgatggaggtcggtttcttcataaccatatccataaaggcttcttccgtgacttccagcggattcaggcggtcatcctgtgtggcagggatgcagtagtcgcgccccgggagcacttcacgcagggagctcatcatcgatgagatatgtttgatactgtcaataatttttccgtcactgttacagaaaatgatattgctgtgttttcccatcagctctacgatcagggttttttggcagagatcgcccatttcatccagatgttcaatatcaaagtgaatgatacgctccatatgcggctggtaaatctttacgatcctgccattggcaatatgcttgcgcagtaccatgcagaagtttggcgcagtcatagggcttggtttattctgaccggtcagatatagaaatggcagggatgcgcttgcggacatggcaagacggaactgcccgttgcttcctttgcaggtgaagagcagttcgtcgttttccggctgcgcgatcttgctgatcttggcatttaaaattgtctggtttaattcatatacgatattggaaatcacaaatccatcaagagccattttgagtacctcttattctgaaaaatttggataattgcgaaactacagatgaacttttgcatgttgcaataatccataaaatctgcccggaattaccgggcgcatggttcattataacggattctacgaaatctgcatagatgcaatatataatttcaaaagccggatcgcataatcacgctgttgctttgaacagcctgagagaatatggatcactgcaagttcatcgttttcctgccgtcttgcctcttcgtctgtctgttccccgaacatcatataatcaaggctcatgtcgagacactcagaaatcgcaagcattgtttctgtggacattccacaggtgccacgctcgatgtctgaacagtatttcggtgcacggtctattctctctgcaacctcgtcctgtgaaaatcctaactggactcttttttttcgaatgcggtcgccaacggctaaacggtcatacgcttctctttttcggttcataaaaactcccctttctcatttgtttcttattgtgtgtgattctctgtatcatattcttgcgaaaaaaacgtagaaataaaacacaatggaaacgtaatttaatagtgagtttaaaaggtatgtgcgagatacgttttaaatgtgatattgaacaaaaaacaagtaagatatgtcagaaaactgtaagtttcttctgttgacataatcaactgacatgtgtattatagaaaatgtttaaaacacgaaaacaaagtatgtttataacgcataagggtaaaattatgaaaaacaaaagaaatcagaaaaatatcatatggaagatactgcttatcattttcagtatcgttcttatcatatgtctcataatcattggaatccaaaaatatcagcagaaaaagcagcaggagtattacgaagccttattggaaaatgagagcacccagactcaggcgactgaggagatgccggagccggaaacggaagaagcaccggacattttaaaaagccttggaattgaaataccggaaaaagacattgattttgcagctttgcaggaagagaacagcgatgtgtatgcctggatctatgtgccgggaaccaatgtcgattacccggtattacagcacccggaggatgatacctattatctggaacataatatggacggctcaaaagggcttccgggctgcatttacacggaaagcgtgaacacgaaagattttacggatccgaacactgttttatacggtcacaacatgaaaaacggaagcatgtttgcttctttgcataattttgaggaccagcaggtgtttgaggaaaacccttacttctatatttatacggaagataaaacctatgtgtatgaaatttttgccgcttacaaatacaatgcgatccatctgatatataatttcgaccttgctaatccggagatttttcagaattatctggatcagatttttgagatccgcgatatgagcgcaaatatcaggcaggatgttacggtcaatgcagacaaccgcattgtcacattgtcgacctgtgtttccggtgagaaaaacatgcgctatcttgtacagggagttttactgaatgaataaacaaaaaagtacagaacagacaaaaaaacaacagaaaacatggataaaaatcataaagatcataggaattgtactgatatgtctgatcctttttgcacttatcgcatttggagtgctaagggcacttggaaaaagtggaatcagaaaaaatatttcaggcgaagcaccggtacttgaatccacggaatcaaccgaagagggctggcaggatggatggatccgctataatggtcagatctatgcctacaacgaagatatcatgacatttctcgtcatgggtgttgacaatgacgatgttgtaaaaaaggcaaaagacggtctgagcggcggacaggctgacgcaatgtttctggcagtcatgaatccgcatgataaatctgtttccattattgcggtcaaccgcaatgcgatggcgcttgtggatgtctatgatgaggatggcgtttacatgggacagtataccaagcagatcactttgcagcatggttatggtgacggcatggaattaagctgtgaacggagtgtggcggcagtgtcgagacttttttacaatcttccgatcagtggttatgcggcgatcaacatgggagcaatcccggctttaaacgatgcagttggcggcgtacaggtgacggttttagatgatgtcatatacccggaatacgatatggatctccatcagggggaggaagtgacgctgaccggacatcaggcttactggtatgtgcgcggaagaaatgaaaatgtgtttaacagctcttccctgcgtttagagcgccagaaacaattcctgaccacgtttattgcacaggcaaaaaacaaggcagtcacaaatccatccattgcggtggatttatacaacaccatatccaaatatatggtgacagacattgacattacgaaatttacatacctcgcttctgaggctttgggatacaactttgatatcgaccatttgtacaccatgcagggtgagacactgatgggagataaatatgaggaattttatgttgatgacgatgcgctgtatcagctcatcattgatgtgttctacgaaccggtagaatcagaggatattaagtaaggaaaattccttatttaatatagaaaccacatggaatacgtgaggaaaggaggaaaacaagttatgaagaaaaaaatcgcagtcgtacttacagcattaatggttatggctatgggaacaacagctttcgctgcaacaagcccaacaaccaaaacatctgagacaactacaacagaggctactgcttatgctaacgttacagtagcagcaggcggcatcgtgatcgatggcgtggcttctacagcagctccaactgtaaaagctgttacaacagctcaggttgaggcagctcagacacaggcagttgcaagcgtagctcctacagctaaagttttacagatgatcgatgtaactcttcctgtttctttcgagaaagcacagttgacattctctgttaacggtgtgacagcaggacagaaaatcgctgttttacatcagaaacatgacggaagctgggaagttatcaacccggattcagttggaaacggaactgtaacagctacatttacatctctttctccaatcgcatttgttgcatacaatgcatcagctcagacaggagaaacaacacctgttttaccaattattgtgcttatctgtgcagcaggtatcgcagtatgcggagcaaaagttaaatttaacaactaattttatgaatcttaagatttataaaaagaaaagaatgaacatgtggtagttcctgcaaaagcaggaataacaggcggtctgtgtcatgcagaccgccggaaaaagaactgacaggatgaagtaaaatgaagcatgcattaataatcacaaccatcagcggattcgtaccgcaatttgaaatgaatgatgtgagaatcttacaggagaatggttatacggttcattatgcatccgattttgaaaatccgatttacaatatcgatcaaacccagttgaaaagagacggactgattttacatcatatcgatatcagaaaaagtccgtttcagatcacaaaaaatacaaaagcatttttacagttaaaacagatcatcagaaaagaacagatcagtctggtacattgccacaatccaatgggtggcgtggtgggaaggcttgccgcaaaagcttccggaagagaaccatatgttgtatacacggcacatgggtttcatttttatgagggggcaccgaagaaaaactggctgctctactatacggcagagaggtttctggcagcatttaccgaccggatcattacaatcaacagagaagattatgagagagcaaaccgctttcgtttaaaagagcatggatgtgtggaacagattccgggcgtcggtgtgaatatagagaagttccggaaaaaaccggaattgagagaattaaaaagaaaagaactggacatcccgccagatggatttcacatcgtttcggtgggagaacttgtggaaaataaaaatcatgcagtcgtgatcgaggcagttgcccggttacacgacgaaaatatttattacagtatctgtggcaaaggcccttacagggaaacattagaacatctgatccagaaatatcatctggaaaaacaggtcagactgttaggctaccgcaatgatgtgcaggatgttctgcagagtgcagactgctttgcatttccatctaagagagagggacttgggattgcagccatcgaggcgctggcatgtgaagtcccggtgatcgcatcagataaccgcggaagcagggagtacatgtgccatacggaaaatggcattgtctgtcaggcagataaagtggcagatttcatgcatgcgatctgccgtatgagacagtccaggcagctacgcagggaaatgggagagcatgggagaaggacagcagaaagattcagcatagaggcaacagataaaataatgcgccgtgtctatcaggagatcagcgtgacgcaggaaagaaagcgataaaagcgtatgggggcagagtttgaaaaacaagtctctgtgatcatgggagtttacaaccagtggaacagagaggcactgcaaaaggcagtaaagtccatattgaaccagacactcacggatttcgagttcatcatttacgatgacggttctgatccggaggtggcaggttatatcagagaattagaaaagcttgacgagaggattgtcctgattggaaaagaggagaatcacggtctggctttttccttaaatatgtgtattggcgctgcaaaagggaaatacattgcccgcatggatgcagacgatatcgcactgccggagcgtctgcaggtgcagtatgattttatggagcagcacaaagagtatgcgtggtgtggctgcaatacgagattatttgatgaaaacggtgtctggggagaacgcaaaatgccggaacttccgtccgataaagactatctgccgttttctcccttcatacatccgacggtcatgtaccgcagaaaactatttgaaaaaaacgaaggttatcatgtttccccggaaacattgcgctgtgaagattatgagatattcatgcgtctgcatcagcttggttatcaggggtacaacattcagcaatacctgtttgcgtaccgggaggacaagcagtcttttcagaaacgcagatttcacttccggatcaacgaggcaaaactccgctaccggaattttaaagccatgcatctgctgtttcccttgggctggctctatgtaatccgtccggttgtgggcggtctgattccgcctggaatcgttgcgttattaaaacgcggtgagacatggtggaaatccaaaaaagaacagatgcccgaaaatgccagattggagtatagcagttatgaatccgaccgaccgcagagaacagagactacaatcttataaaaaagcccaatccgagaaagaaatctatgagcgtgtgcttgcgccgacactttatgagtatgtgctgtgggttttgcaggagactctgcaaagcggaaaaaagcggctttactttctggcaagggatggctatcagatgtatcttgccgcacaacagctctgcaaacaatatgatttggacatcgagtgcagatatctcaaagtgtcaagatatgcggtgcgtgtgccggaatatcatcttctcggggaacgctgtctggaacgcatttgtgtcggaggaatcgatgtgacctttgaaaaaatcatgcagcgtgcagcactgacagacaaagaggcagaggagatcgcagcacttgccgggtacacggagaattacagaaaagtcatcaattatcacgaggtcatgcagttaaaagaccgcttaaaaaagataccacttttatttcattatatagacagacattccaaagaagcttatgggacagcaatcggctatctcacgcaggaggggctgctggaaccggttccttatgcactggtggacagcggctggatcggtacgatccagcagagcattgaacatctgctccgtcagaaacagccggacagaaagctcgaaggatactattttggtctgtatgagatcccggaaggggaggaaagggaaaactatcacagtttttacttcacgccgtggggcgagatcaaaagaaaagtacatttcagtaacagcctgtttgaagcagtattttctgcaccggagggcatgacattatcctacaggacagagagcgggaaggataaaatcatctatgttccggtgacagacagcagggagaacctgaaccgggaacggatcagccggtatatctgctggctggaagagtttctgcaggagaaaaagcaatcattgccgcaggcagacagcgggtatgtggaggaacttctatcaccctttatgggaaacccgacacagtttgaggcagaggcatacggaagcctgcttttctcagatgatgtgagagaggatgacaatcagaaagtgtccgcagatttttcggagcaggaaatcaaaaaccatcatttgctcaaccgtctgctcatcatgacaggcgtccggaaaaaggtactccatgagagcgcgtggatcgagggcagtatcgcaacgtgcggaacactgaatgagagaggcagagtgagaaaccgtttgcatgccgttttctataaatacatcatttatatccgcaaatggataaaacaaaatatgattcatggcaggtaaattacagcctgaatcagattatcagattgcagaagaaattgaccgcaaagtctagaagataaagctcaaaagaaaatagagaagaaaaaacagacaggaaattacagtcgtgagaaagaataaggaagaactgaaacaatattactttgtcatcaaacagcttgtagacagagagattaaaagaaaatatgcgagatcttttctcggtgtgatctggagtgtgttaaatccactgatgaccatggcagttatgtccatgatcttcagcacaatctttaaacgtacgattgaaaactatccaatctactatctgaccggaacgattttctggcagctcttttccggtgcgacaaactccgcaatgacggcgctcgtcgataaccggacgctgctgttaaaagtaaaacttccgaaacagacatttgttctggcaaggatctataccgcactgactaactttggatacacctgtgtcgcctatgtgctcatgctcgtcgtgtttcagatcaaaatcagcccgacgatgttactgtttccgatcgatgtatttttctgcctgctattctccatgggaatcgggtacgtactctcaatcctatacgtgttttttgcggacatcaaatatctgtattcaatcgtcctgacactttggatgtacatgtcggcgatcttttatccgtatgagagcacaacgctgatgatgcagaaagtcatcggaaacaatccggtgtttgtctacattgcatttgcgagggactgcgtcatgtatcagaaatggccggagacggatctatggatcaaaatgatcttgtggggcattgtaagttttctgatcggttactacgtgttctcgaaaaaagaaaacaatgtgatgcagaaaatataatggttagatacagaagataaaatccatgaaggaacagtacaaggaaaaagcagagattggagtgaagatacaaaagtgagattaaaaatctgggaaaaatggaaaaggataatactcctgggcacattctttgtgttggcaataggaataccgtgggaaatccgtgcggaaaatgcagctgtcacgttcggatctaattattatacggcaaccgacaatgagacatttccaatcggcgtatacctgaacggggattcgaggattggaacctatgaggtcaaaatatcctacgataacaggcgtctggagtacaccggaggtggtgattccgaggaaaacggagttatcacgttaagtggaaccggagtcaatgcgcaggtcaaatacatgttaaagttccagacgcgaagcggtggaacggcagatataaaaatagagagtgcagtgatccacactgcaggagagaatgcagaagagtttgatgtggcaactctggcgtcaacgtatgtcacgatttccggtgaagatacggttggggacgctccgccggaggaaagtcaggagacggaaaccggagaagaaaatccggtttcggatattccgacagtgatggaagtgccagtggaagagcagacctactatctggtagatctctcccagtacacgccggagaacatcgatttccagtatgataccggaaccatcacctatcagggaacagaagtggctgcatatctgtcagcaaatggagatatcagttttgtgtatctggcggacagtcaaaaaaaactttacctgtacgcttacagcagtgaaaaagataaactgtatccctgcaattccatcacagtcaacggagaaaaatattacttcatgtctccgtatgtgtgcagcgagtggccgcaggaactgacacttgacatcatccagagcgaatcgatcgtctatgcgatggatctggaaggtcagaccggattttataagatcacgaccggaaataaactggaagcctggaatccgaatgaaggtcaggagaactttcagaatcagatgaaaatattgatcatcattctggctgtgacattagtgatcatgtttcttgcaattcttctggttatccatatggataaaaataaacagaggcaggatggtacatctgtatccgggaaaacaaacaatcggattaaaaccagaaaaaacaaattaaaacaaggagaatccgaagcttcctctgacacaaatgcggcagatgatttagagatagaagatctggcactggatatctccgaggaggagatccgcgcatggcgggcggaactggaacagtctgacggagatgataattcacccgataaaaagaattctgatggacaaaatgttgctgaaaagtattccaatacggctgtgccggaggaacgtgcaggagaggagcctgtcattgctgtgaaggatgtcacgatgcagttccggattgcgatgaacaatgtctctggtatcaaagagtatgtgatccagcttttgaaaaaacagatcagttaccgggaactgcttgcgttagatcatgtgtcgttcaatgtatacaagggcgaagtggtaggaattattggaaccaacggttccggtaaaagtactcttcttaaaattgtgtccggagctttaaaaccgagcagcggcgaagtgcagtgcgaccgccggaaagtgcagctgctgacacttggaaccggttttgatgtggaactgaccgcaaaggaaaacgtgtacttaaacggtgctatcatcggttactccaaagaatttattgattccaaatatgacgagatcgtcaggttcgcagaacttgaaggttttatggaagagaaagtaaaaaacttttcctccggtatggtcagccgtctcggttttgcaatcgcaacgatcggcgaaaccgccgagattctcattttagatgaggtgctttcggtcggggatgaatttttccgcaagaagagtttgaaacgtgtgcaagagatgatccacggaggaagtacggtgctgctggtgtcgcatagtatgggtacgatcttagaaaattgtgaccgggtggtctggatcgaaaaaggaaaaatgaaaatgtgcggtgagccgaaggtggtttgcgaggcttatcggaagatgaatttaaatgaataaggaaagttgtgaggggtaaaaatcatgaaaaatatagctgtaataatagcaggtggtgtaggacacagaatggggcaggatataccgaagcagtttattcatgtatatgataaaccagttttattatatacgttaaaaaattttcagaatcatccacaaattgatgcaatcgaagtggtttgtatagacggatggcatgatgtggtttgggcttatgcaaagcagtatggaattgataagttaaagtgggtagtatctgggggagaaacaggacaggaatccattagaaatggtgtatacaatttgatggataagtgtgatgacgatgacaatgtgatcatacatgatggaatcagaccgttagtggagccggcagttattacagatgtgattgcaaaatgcaatgagtatggcaatggagtatcatcaatgccttacaacgaacagatttttgtgattaatgatgaaggaacgacaacaaagtatattccaagagaaacgcttcgcagagttgtaacaccgcaggcatataaatttggaaaactgaattgggcatatcataaagcatttgaagagaaaattggtatatatggaagctcctataccaacacaatgatggtggaattaggagagactctgcatttcgcagcaggttctgataaaaatattaaactgacgacaaaagatgatttagaaatatttatgggatacttgaaacggaataaagaaacagaattaaagtaggtgcggtatgaatttattaaagaacaaattatatagggaagatttagcatatgtatcagaattgaatttgccatgggaaaagttaaagaagaaatcaattcttttgtctggagcaaccggaatgataggaagtttcctgatcgatgtcatcatgtacaagaatttaaacgaaggtttatgttgtcatatatatgcggtaggaagaaatgaggaaaaagcgagaaatcgttttaaggaatattgggagaatgatttatttgattttgtgcagcatgacgtaaataaagcaatggattgtatacaatgcaatcatgtaaattatgtgcttcacttggcaagtaatacacatccaatggcatattctacagatccaattggaacaattacaacaaatattatgggtgtatataatatgctggagtttgcagatcgagtacatgctgagaggatggcatttgtatcttcaaatgagatatatggtgagaatcgtggagatgtagaaaaatttgatgagaaatatttaggatatattgattgtaatacaatgagagctggttatccggaaagtaaacggtgcggagaggcattgtgtcaggcatatattgcacaaaaaggactggatgttgtaataccgagacttacaagaagttatggaccaacacttttggatagtgatacgaaagcattaagccagtttttgaaaaagggattggctcatgaagatattgttttaaaaagtgcaggtacacaatattattcatatacttatgtggcagatgccgtggctggattatttatagtattactttgtggggaaaagggagaagcatataacatatcagataaagcatcagatattatgttaaaagacttggcggcaataattgctaaggcaagtggtacgaaagttgtatttgatgtgccagatgcagtggaagctgctgggtatagtacagcaacaaaagcaaggctggataataggaaaataacagaacttggatttaaggctagatatgatatagagactggtataagcagaacacttaagattatggaagaataaggatgattttgtgcggatatggaaaataagaaaatatgtatagctattgatacaaaggataaaaagaacaacatcataagaacagtaaatgcaatcaagcgtcagacatcatatgagaatattatgatggtgattctgtatgattgtagaaaaaatgatgagtttaccgaagtagatgaaactatatcagcagaaatagatgatatagtttcaaacaatgaagtggttaacaacataaatgaattaaagcaaatattggaagcaaatgatatcgaaaatgtattgtttgtcaatgaagaaataattttggcacctaatgcagttgagcaaattatgatgacagacgtggaatcagatgaacaacttgtcctaaaccaccttaagcttgatacaggaggaaactatgttgcagatgaaaagatacaagtttcgccatattgtaaattgtactcattacatgatttatttgaaattgtagatgatgacgaattatgtgtatgtaaaaattggcaattgaagtattctttcgctggcaagactgcaagaatgattgatgcatacgcatatcaaattggtgatatggggatatgtgttgactataaaactgaatatggatatattaagtcaattattgaaaatgaagatatcattggaattggtgttgtgacagatgttatagaaaaggcattatataaggcatttaaagaatctattgaacatgtaaatgaggaagcttatgctttccttcaaaaatgtatgacaagtctttcattagataagacaattttagaattagaattaaaaaaatataaaattgtaccagaattgtgtgcaataattggaagatgtgatgtaagtcaatttagaaagatgtacgaaaagtttgagactttggcagacaaagagattattgctgaaaaaggagattcaaaattaatagaaaatttacagaacgcaataaagaatttggaaactcgagtaagttgtttagaacaaaatgattatacagtagaacagcatgtggagagtatgtatcaaaatggttatgcagtagggcagtatgtggtgagtatgtaccaaaatggtaaattaggcatgggaacaataattaaatcaactatagcatggataaagtataaattgtcaggaaagaggtagaacggtggaaaattttgaatatagagtgtcagtaattgtgcctatatataatggaagtgaatatttgaaaaagtgtttggattcattattaaggcaaaccattggaaataatcaaatggaagttttattaataaatgacggatccacagacgagagtgaaaggatatgccaagaatatactcgattttataaaaattttaaatatttttataaagaaaatgagggattatctgctacaagaaattatggtttgcgaagagcaaatggaaaatatatagcatatcttgattgtgatgatatgtattcaaaagagactttgaaaaatgtttgtgatttttttgatatgcattatgaagaaattgatgagattacaattccgattgtaaggtataaaaatgggaaaacactacctatgcactataggtataaatacgagacaaagacgggaatctatgatttggatgaatttccatttgtttcacaaactacaataaatattattgtaaaaaacttgttagaagataatattttctttgatgagacacctaattttagacacgaagaccaggcctataataatgaaattttaatgaaaaaacgaaagattggttttgtggaagaagcagaatataaatataatcgtgataatgatacggggatagttaatacatttatgtatccatactatatttttgaaactactatggcatactatgaaagattattttcagagtataatgaagttccgagatatatacaggccttatttgtacatgatttagtatggaaactaaaagatgataagttattgccatttcattatgaaaccaatgactttaataatgcaatggctaggattagaaacttattgtccaaagtggatgttgatattattactagccatcctagcatgaataactttcatgctcaatactggttaggattaaagaacaatgcatatccgcttgtggtagcaactgataagagtactgcaatatatgttgataataaaaaaatatatagcagggattattttgaaatcattatgcataaaatcagagtttgtaataacaaattccgtatgttagcatttgtaaaatcacctgtatataactgggtaaaggatgaagctcatgtatgggtggttgaaaacgatacaaataaaaggaaattagaagtttttccttcagttcatagctattttcaaaatacctttgttaaaacaaataatttttgggcatttgattatgaaattgatctgacagggtgcagtaatttcgaattttattttgaaattgagttagatggaattatatatccaactaaatattggtttatgcctgttgcagtatttggaaatgacaatagtattactcaatatgtcagagaaaattactcaatatcagttcaagacaaaagaaatataagacttgaaaaaattgatgacaatatgaaaacgcatatagaaaataaaaactcgaagagatttgaaaaagactcatacgtgacaaagatgcgtcaagagagtattgcatataagaaggaacatagggtatggctgtattatgatgcatatacggttgaaaaggataatgggtattttcaatttgcaaatgatatcaagcataatgatggaatagaaaaatattatgttgtaacaaataagaaaatatatgaagaaaatgataatttagagcattttgtagaatttggaagtgagcaacataaattattatatttggcggcagaaagggtgtttacagcgtattatggattttcgcctatttcaccattcttagcagaaacgaatgaggcaaaatatatagatttaatcgattttaaaactatatatctacaacatggagtattgcatgctgccttgcgtacatttaatagtgtagaaagatgtagagctgaacagatagtagtatcgtcacaatttgaagtcgaaaattataaaaagaattatcattacaaagattctgatttgattactacaggaatggctcgttatgaccatattaatagagaaacttctgcaaaaaggcaaatattgtatgcaccttcttggagaaaatatttgacttattcaccgaaagcatcaaattggcaattacaaacagataagttagtgaaatctgattattttaatgggattttagcatttttaaataatgaaaaattaagtgattatttggaaaagaatgatttagaacttcatgttaagttgcacccaattatagcagagcagggttcggaattagtttcagtatcatgtgatagaattaaaattttgaattgtgatgtgaaagtcaaggttgaggagtactgtgcatttattactgatttttcatcatatgtttttgattatgcttgtttgaatagaccaattatgtattatgttacagattacgaacaatttaaatcaggtatgaatcattataaagaattggatcttccatttgataaagcatttggtccactatttgtaaaagatgatgatgtgattaaatatttgaattgtatatcagaaagaaaatttgagccggaagacttgtactatcagagaatgaaagatttctttttaccattagacaattgtgcagaaaaattatatcaatacattatttaaatcaaatttgagagaaagagtgggtatatgataaaagataaaataaaggtcgttatttgggacttggatgataccttgtggaaaggaactttagctgaaggtgatgatgttcaattactagaaaatagagtcgcaataataaaggaacttaataagcgtggaattgtaaatgcaatatgctcaaaaaatgatccggataaagctaaatctaaactggaggaatttaaaatctgggatttatttgtattcccaacaattgaatttatgcctaaaggagaaatgataaagaatctattatcagctatgaatcttagaccacagaatgcattatttattgatgataatgatctgaacttaaaagaggcagaattttataatccagaattaagtatactgaatgcagatgatgcagatactatcttgcaaaatgaatttcttaaagggaaagaggatttaaagcttactcgattacaacaatataggcagctagaactaaaggctgaaaacagaaaggcttattcaaataatgaagcatttttgaaagagagcaatatatgtgtacaatttatagatgtttcttcagaaaattttgaacgattatgcgaattgacagagcgaacaaatcaattaaactttacaaagaatagaatgtcttcagatgaactacatgatttgatgaaagaaggaggctgtgaaacaaaactaataaaagttacagataattatggtgattatgggctggcaggtttctattctataaaaaataacaaattgattcattttgtattctcatgcagaataatgagtatgggagtagaacaatttatatattgttatcttggaaaacctcaattagaggttgttggcgaatgtgccagtaagttaaattatgagcctgattggattaaggttattgaggaaaaacaagtacataatagcgaagatgaagcattgatatggaacattcttaaatctgaatcggagcttaagatttttggaattggggcatgcgatttgtaccaccctatggcctacttttctatgcctaatcagaaatttgtttatgagtgtaatgttttcaatggaaaagaacgtggtgtaaatgttggaactgaatacattaggtctacaattgaaatgacagatgaacaaaaagcattttgtagaaatcatttttttaattatactggttcattagcatttaattctcagatgtttgaaaaagagtgggattatgttattatgtctttccatgatgatatgatatttaaaaattatatcaataaaagggagggcttctctgttacgctaagcccttcacgaaaatttggtgatacttcagttataggaattgaggatactacctatgagggaggaaaaaagtggctggatgaaaatttttatccaggagagtatatatcggaagaaagattttatgaaaatattaaatggattataaacagattgccagagaaaaccaaattgatatttgtaaatggaccaacacttgacttctttagaaaaaataatccacattgcccagaggtaagagaacagattaaaagaataaataaggtcttagataaaatcgttacagaaaataaaggaaaatgcgcactggtcgatattaataaagttattaagtcgacaaatgatgtgacagattatgtttttcatttaaaggcacaaactgcgtataatttatttgtagaaatagtatgggctattgttagaaactttaaaaatatcaaatcaagtatgttggcttctgtaagaacggatagaaaagtagtgatttatggtaattcatctgaagcaagaaatgctttttacaatttgaagttaggaggagaatccccaattgcatattttcattttaattacagcaacaaaaagattggcacaatggaagtaaaaaattctattgaattgaaggataaggcctctcaatattatgttgtcatagcagatgaaaataatataagcaatatagagacggagttagaagcatacggatataaaccacagacagattttacaagacttcaaaaggtggaatataaaaagatgtggaatgaaaatatttcggggggggacagtctaaaaataaacaatgtgttgatacagtagcagtatgtcgtgatgataatgtatcaagaataccttctgctgaatcgaacaagaggaaaactctgatatgtgtgaccaataattcggatagcgtttattctgtaatttcattatcaaaggattttgatgttcgcaagaaatcaatagagcaattttccaatctaagggtagaagagttaatggagactgattattatatctttagtggggagatacctgattttataatagaaaagttagcaagaaataatcttgataagcgtataagatatataaatggaatttatgactcgaatgtgtatgatatattatcaccagatatttcatttagactattgaaagaacaaattcgaatttgtaaccaaaacaaatatgctgtggagaatttggtcgaagtaggtgattttacatatggagttcctcaaataaattttattggacataaaaatgcttatattagcattggaagattttgttcattcgcaaatggggtaaaactattcgctggaggagaacatcataaagagtatgtttcaacgtacccattttcaatgttttttaatgggaggtataaggtaggaacacatgcagaagcaaaaggaccaattattatcggaaatgatgtgtggtttggagctgatgcaaaggtgatgtctggagttacaattggtgatggagcaattattggtgctggagctgtcgtggcaaaaaatataccgccatatgcgatagttgcaggaaatcctgccaagattatatcattcagatttgatgacgaaactataaaaagattattagacattaaatggtggaattgggactattctatgttagataaggcggttccgtatattcaaagtagcaatatggagggattgttttcgttatatggttgctacacaaactaaaaacatacattgttgatagtatgagcttagatttattataaaagaattatatagtattaaatatatgaacgagaaagacattattacgattatttgtcctgtatacaatcagcaggattgtctgaaaaaatacataaggaatctgaaagcacagacttatggttttcatttcatgcagataatttttattaatgatggttctgttgatttgagtggagaaatatgtgccaggtttgtagaaaaatataagaatatactttatattgaacaagaaaatagaggggtatctgccgccagaaatgcaggtttaaaagaagctgttggaaaatatatattttttatagatgccgatgatttgatttcgaaaaatacaattgctgactgcgtctccgaatttaacaaaatctatgacagggtagatttacttacatatccgatagaaacatactataaaggcaggcgtttaaaaccgcattttagatatcaatttctaaaggaaaatggcagctatgatttatgttccaatgcttttatcggacagacaacgatgaatattgtagtgaagaataagttcgaaaagaatgttttgtttgatgagacattagctttttcagaggatcagaagtattgctgtgaagtattgcgagacaaacttgaaatgggattttgtaagtctgcaagatatatttataatcgcagtgacgagagctcttctggaaaattatctggagcatgttatatttttgaaccgtcattaaaattgtttgaagatttatttgcaagatatgaaagtgtgccgttagcgtttcaggggttgtttgtgaatgatatttattggaaaatgctttctaatatattttttccatatcattattcgaaagaagaatatcgcagagcaatgtctcgtgtgaagatacttttgaaacgttgtgacaattttgttattttaagccatcctaattttgatttttttgaaaaattttatttgatgaaacttaagggagaacagtatattgaaaccagtcagtttagtgatagtgtcagtttattgagcaaaggtaatgtggtgcttaattctgataatattgagattgtggttacaaaacttaccgtacatggaacaaaagtgagattgctgggtttcttaaaaagtgtattttttcagttttataaaggttcatttgagctttatgcaatagaaaatggaatacagggcagtccaatttctgtttcccctagtgcgcacaattattatttgtcacacgagccgacacaaagattttggaaatttgaatatgagtgtgatgcgagagaggttcagaatttatggttcaaagttaaatttgatacagcggagcttaagacaagctattattttatgccgcttattccaattcatgcggagttgacggaatatatcaaagatcgggtaaaaatcatatatcatgaaaatcaatggtatttatcagaagttgaagagaaaaagccagagaaagaaatctggctgtattacgattgttctggagttacgatagataatggattgaaacaattttgtcatgatatagcaatgagcgatggcattgatcgatattacgtgcttacggataaaaaacaaaataagtatattccaccaaaagcaaacaccgtaatatttggctctaaaaagcatgtggaacttttattgcaagcttcaaagattattacagcttttattgaaaataacaatgtgtttccgtttcccgaaaaagaatatagccgatatgcgaatcaaatgcattttgaaaccatatatttgcagcatggggttttacatattgatatgccttggaagtattctcctgaaaaaataattgcggataagatagttgttgcatgtgatgtagattatcggatttttcgtaagaatggctttgctaaaactgatttgtggaaagttggactgccaagatttgatgaattgcataaagcaaataaatctgataagcaaagaattctatatgcaccatcatggcgaagctatctggtcggtgaaaatgtaaacggtgactggaaagcattagataagaaattcctttcttcaagatattacatggaaaccaaagcttttctggaaagtgatgtgttatacaaaatgctggagaaacaggaatatacacttgatgtaaaggttcatccgatttttcaaaaatatgccgacaattttattggcagtaatgacaggatacatctgaaaagcagtataaatgaggaagattattctcttatgataacggatttttcatcgtatatgtttgatttcctttatcttggaacagcgattttttcttttatacctgattatcaggaatttaaatgtggcatgaatggatataggaatgtggatttcatgactaaaatagatgaagaagagattgctaaaacaagtgatgagattattaataagattgagaagttctttatgacgagaaaaggaatgttgtacgatgtgcatttctggaaaaatgacatatgtaatgcaacagaattgatatatcaaaagatgacaaatcagccctgcaagcattagcttagcagggctgatctgtcattttaccaatatttttccatataattccgtgcatcttcctcggataaagaaaaatcggttataatatttttgagagtttcctcttttgaaaaagaacatttttgctatattaatctgtagaacgagtttcggcaagctgctttttgagttgctcgataagtcttgcttgttcagcaagagcattgtctttttcagcaatgacattatctttttcggcaagagcatgatccttctcttgaacttccttagctaattgctcaaccatatagatttccgtattgcgatccatctcacgaagtgcatctgaaaatgtagtaatcaaatctttcggcctccttcgaaatgaaataatatcccgatagcatggaagaaattccggataggcattgacgagacggacgatttcatccggatcatctgcggtaagaaaactcagccatgctttctgttccgtatctatattttgaactactgagcggaaagtgtcaagtgaaatgaatgtaatgttgtcaagaagatttatttgtacatcagtgtcaaagcatgatattttcctatgaatgtattcattagtatggtgaaattgagcaggactatgttccatgaaaacaatcaggtacacggaacgcatgtcttgataggaaaaagatttcttgttttgatttttcagatagttatattgtcgcatgatcatgtcagcagtgtagcagctgctccgttccccggggaatgcgtacccgattttctgaatctcaacgttgataatggagccatcttccatggatgcaataatatctgcaatgacaaagctgccattttcgacaatctggctgccttcgcgtggaagaatttgtttaatgtgtattggctggtcaaaaatgattgaaagaaaatgttccagccgtttggtgtctcctcccggaagcatgacatgtcggaaaactgtgtcataagtgatggaaagcccatttttacccataataaaatgcaataatttattacgataagtttcgttgagattgacgtagttctggaaagtctgctcatctgagttcgtttccttgcggatgagattttgtgcttcctgttccgtgattggttcaccgagaatatcagcgagggtgtaaagcttctttgtttctgccataggcaaatcctccttgtgtagaaatgatgattgagttgttttttcttgaaaaaggttgcgatatgcaacagccagattcaaaaagatttttgttatgtttgcgacaatcaggcaattatttttttcgtgcaaaacaataacaacaataagaatcgtaacagagagaagcactattccttttaagaacacttgaaatataacgaaattacgttataatagagtattggagggagtattatgaatgataattttaatcacatgataaaagaaaccgggaaaagtatatataaaataagtcaagagagtgggattccttacacaacactgaatgaactggttaacgaaaagaagaatatcaattatacatcagcggagacggtatacaaactgtgcttatatctaaaatgtgatatgagtgatatcttaaatgatgtcatttttcttgagaatggaaaaggaaactatcttgggtatcattatcaatggaaaaaggcagatcaaggaatcgaattgcatataacagacaataacaaagatttgacattgcttacacttaaaacaatgtgtacggatttgtatgattgttatatgaagcaggttcctgaaatgatgattgaaaactatgacgaagaaaaacgggaatgggaggggttattatgagtcaatacgcattaatgcataaaaatgatgtgtgcggaagtttggttattgatgacgaaaccggatcattaagagtatacaaagataatggcagcggtttatccccatttttaggaaatgcagacacaagaagaatgaaacactggtgggagggaagggcagttccggcgtcaagaaaaatgatgcaggaagtattgaaacaagcaggatgtgcaaacacaaagatgtatctggcaaagaatttagcactttctatgaccgactcatattggatacgtccgttggatttagatttaaagtatgaagatgtaaaattatcaaatatgaatttgttttctgacaataaggttccatatcacaatgcaacttcatatgattcgaatgccgcattaggcggacaaatggaaaaatattgggatatcaaaacaaattttccaacgcttgtgaaagaaagttataaatattttgggcagcaggcgatgaatgaagcatttgcaacttatttgcatgatttacaagaaacggcaattccttatgtttcttatcttgttgggcatacagaggataatggcctttattgtagatgtgatgcatttacaagtgattctgttgaattagtatccgcatatgaagttatcgaaggatcgaagcaacagaatgataaatctgtgtatgataattatatccggatatgtgcagaattaggaatagaagaacagcagattcgtaattttatggactatcagacattgacagattttattatcagtaatacagacgaacatcttggaaattttggaattctaagagattcgaacacaatgcaatatttaggtccggcgccaatatatgattctggaaatagtatgttttttaaggattcattattctctcagacaagattaagtttactacagcaatcgattacaagtttttatgattctgaagaaaagatgatcaagaatattaaaaacagacatgtggtaaacatggatttacttccaacaatagaggaaacgattgcgctttatacctcgtatggtttcccggaagaaagagccataacgattgcaaacaattatgcattaaaaattgatatggctcgtgaattcgaaaatggagcaaccatctcaatgtatcatgaaaaaaataacactgaaatctagagagaataaatagcgatacaaatcagccctgcaagcattagcttagcaggactgatctgtcattttaccaatatttttccatataattccgtgcatcttcctcggataaagaaaaatcggttatgatatttttgagagtttcctcttttgaaacagagaattttttgtaggttttaagggtacctataatttcaccctgtgtaattccggattgaatgccttgctggacgcctttctgaatacattcttcctgccattcttcaaatgctctgcacatattgatcgaacctccttccgaatcggattgtaacgcatggttaataaatgacttggtatttgtgatcgtgccaatcaccagactaagttctgtatcaaacttctgattcatgtatgtactttggattttatcaaattctttgttataaatcaatctgctgagatcgaatacagtgtgaacttcactgttatgaaaaatcagagaatcactgtttctgatctggataagattcattttataatctgataccagaggcgtgagatgttctggaatgcatagcatatcagtcagggaaagaggtccatccaattcgtcttcgccatagtaaacacagagactgatgacagggtgcaaacggtctgtctttttaagacctgaaagaaattcatctgaagatgaaaaatttttttcgtgtttgtttctggcagcaatttcattatattccttgagataagagagagcatcgccaagcatagtgcgaagcggcattgcataatgaattttacattgattctccaatccccagataacgaaatcaacaccataagctgtctttttcacaacatcccagattctctggatggtttcagtatgattgttaaactttaacaaagaagaaacatcggtatctgcttccgataaatcttccggtttgatgacctgtgagccgttgaaaagagcggcattgaacaggtctgcaaagtgttcattgtttttccagaagttttttagaatggtatctggttttaagttattgtaagtagtcgtttttaaatcctcccgttcttatgtaatgggaaagttacacagagtctgtattattcggaggaaaaccggtaatataccgggagaacgatatgcatggattaaatttacaatatatgataaggaaaaacaagaggcaggggagtttgtttacggaaatttaagagtttggaaggaacaagcttgtttaaaataacatttatagtgtatgatataaattacaaaggtaagaaagaaatataaaaagtaatagtggagagaatatattgataattagtgaaaaaattttttatttgctggatcagaagggaattacacaaaaagattttgcagtacagacaggaatttctcaaagcacaattagcgattggaagagaaagaaaacaaacccatcggcggataaaattctaaagatatgtgagatattgcatgtgacaccgtatgagttgctttccgaaagagatgaggcaattataaataatatagatcatcttgtggcattgaatgatgaagaagcggtagtattggaaggctttagaaatcttgaaaaaagaaaaaaagaaagattccttggttatttagctgctctgcaatcagaagactaatgaaatactttaggtaaagagattgacaattatgttattttatattaacattcgtatatacgtaacgtaaagcaatatcgatgtgaaaggaaacaaagcaatggggaacataagtattatggcaagaagattttcagatggacacgtgcaatatggatggagtggcaatggtggatattttagttttacaggagcacatttactccaatggtatcaaaatagtgatgcagtagaatacctttttggattagggcagactgcatgtgtcggaagagttgggagtgaaaatggtggatgttccattatggaaacgaatgcaccaacaggaagaccgttttggttaggtaacacggaacgtgaaattttcagtaaaattaattggattgattatgggtatttttatgatttggatcataaatggtattatattattccgggaccgtttcgtattaagctgcctctggaattagtgaaaaataatctggataaggcgggatacgaatttgaatatcgaagaaaattggaagacgaattacttaaatatatacttgatgaatatagatgtacttattctgattttaatgagtttataaaaaaagaagggtatgatttagaaaaagtttttaaagaaattcaatgtgatggcaagctgtctatgtacgaattatttagcaaatatcataaaatttttgcatattttgatgattgggtattcattaaatcagatgatgtatataaagatattacagaaatccttgtcaaaaagaaaggtgatgctcatttagaaacttgtacttggtaagaaaagaaaaaagttcttacaatgtcttataaaacataaatgacttctatcagccctgctggatgtttcaagcagggcttgcttatgtgttgtaatattttatcattgaattatgccatttgtaggaatcaaataaggtgtaagtccggcggacgccatgatggaagcaagagtggcacgaacatgcggaaacatttgtaatagagcatattcggttaattcatccgttgaaaactttgtagagcaatctggagaactaaactcggcagataatactacttttacaaggaaagaggtatctagcatatcaacatcaagttcatctgcaaatctcatttcagcagagcaatagccgatatatttatttggagcatcatttgttggagtacactttcgtgaaagtgtaagtttcatttcttttccatctatcggagctttattaataataaatgcttcctgagttgtaatcgagtccaaatttatactaatcatatttaacattacatttcctccaattcttcgtcaactttcacatatggatttggaaattgaataatcttacatggaacttcggtagtaaccatattgtcatttctagaagtatctgtagatgaatggcatttatttattttaaaatctacattcaaatctagtttggctgcaatttcagcaattttattaattgaaaaattgtagtctccacattcccaacgggaaatcaatgattgggttgcatttatatgtttcgcaaaatctttttgagacatattaagatttagtctttcggaagtaatggcattagaaaattgagccattaactttgcagagaggacatctgcgggtgttaatgtttctgaaaacagagagagtaaatcttcaatattattgggtgtcttttttttattcataattatcatctcctaaaaagtagttaatacgttctttcataacagtagtataggttgagtaattagtacgattttttccagaacgttcattgaaagcacataaaaagtaaggtatattctcatcatttatatatacaatcagacgaacattaaattgagatttctgtagatgaatggaatagtaatgtccatctgcaccttgaagtatttcattgctgtctatcgtatatatctttgaaccaaaattttttatattgcttaattgtgtagttaaaattttaaaaaatatagattcttttccttttaaatctgtttttaatagtgttcttaattcttctaaaaattttggatggataaaaaaagaatttaataaagaagctaattctttcagcatgtcttctgtattcatgttcactccttataatattacatatatgcgattttttcaattggatacataaaaataataaaaaaaacttgtcaaatactggagttgtgagatgacctatgtgtaatggagaaattgaataaataaatattagttatatgtgaggaaaatcggtaatataccgggagagcgatatgcgtggattaaatttacaatatatgataagaaaaaacaagagatacagaagtttgtttatacaaatttaagagttggaagctggtaaagttgaagcgcatattttgactttttacatgcaagtttccacaaattgacatctccccctctatgcgctacaatgtaactcaaaagtcatgtttaaaacgtatacagaaaatactatttaaacaaaccatggagaagacattgagagcaaagatatatcattttttagtgaacagaaaaccggggatcaggcagcgttaccacagatttcatgatggaacgacagggatgaagaaggtggtttcatggttttatctgctgtggctgaatttctgttattatgtactgttttgcagatttcttggagaacagacagagtttccagtttacgaggaaaagaaaccgccgtgcgcagagagtgagtccgtgctggcaaaccgtgaccgtaggagtgtatcggaaacggtttcatttttgatgcagtatgaagttatatcgtttgatatttttgatacgctcattttcagaccgttttcggagccgacagatttatttttctttcttggtgaaaaactggaaatccttgattttaagagactacgtatgcaggcagaagcagaggcaagaacacaaaagtataaagaagagaagcattatgaaatcaagctttctgacatatggagcaggttacagaatgaaatcggtgtcataaaagagcagggaatgcagatggagcaggcattggaaatggagttctgttatgccaatccatttatgcagcaagtgtttacacagctgcgggaacatgggaagcggatcgtgatcacttcggacatgtatttatcaaaagcatttttatcggagctgctgcaaaaaaacggatatgaaggatatgaggaactatatgtttcctgtgaatatgaaaagagtaaggcagatggatcgttatatgaagttgtaaaaagggcatacccggacacggattctatgatccatgtgggcgacaatccggtaagcgatgtgaaaaatgcgaagaaacacggatttgaggtgttttattatccgaatgtgaaccgcaatgcacttttgtaccggtcatatgatatgtcggcagttgtcggcggtgcgtatcgcggaattgtaaataataagctatacaatggcacggagcagctgccgatggagtatgagtacggctatatttatggcggattgtttgtgcttgggtactgcaattttattcatacatatgccagagagcatgggattgataaattgctgtttttgtccagagatggggatattttaagacaggcatatgctatgctgttcccggaggagaaaacagagtatgtttactggtcgagagctgcggcaacaaaactgatggctcgttataaccgctatgattttttcagacggtatctgtatcataaagcggatggaacttataccttagagcagattttaaaatccatgcggctggaatttctgctggatcgtctgttacagcgattgccctatgaaatatatctgacaagtgggaacgtcagacaggtaaaacgttttctggaagcaaactggcaggaggtgacagccgtttatgacagggaatccaaagctgcggaattatactataaaaaagtactgggcgacagccggaatgctcttgcggtggatatcggctgggcagggagtggggcgatagcgctggactatctggtacagaacgtatggaagcttccgtgcagcattaccggggcgatcgcgggcactaattccgttcataattttgaagtcgatgcgagcgaaatttttttgcagaatggaaaactcgcagcatatctgtatgcgcagtcgttcaatcgagacttatggaaaaaacatgatccaaacacggatgacaatatcttttttgaactgctgctcgcctcgccgacaccgcagttccttggatttgaactggatgaagcgagcggggaggtttcgtatttattcggaaagatggatgcaaatccggagggaatgaaagagatccagagtggtattctggattttgtgcgtgattaccagaaacatttttccgggtatccatatctgttctgtgtgagcggaagggatgcctacgcaccgattctggcagccagcggaaacaagaaagcttatttgaaagcactgaagaagaaatttgaatttgaggcaaatgtattatgaaacgacagattaattatatcctgatgcagaccgttttgtggggtggctggatatgcgaatatatttggttcctgaaacatcagtttcagatgcggtttgatctctgggtatttgttgcgtacctctttttactttatctttgtgtggtccggaaacttggaaataataataacaggcgctatgagatttatatggaactgtggggaaggctgaccgctgtaaatgtagtctggtatctgtttgtgggagcaaaaacagtgcattttgcaggcattcttctggttttatggaagctgatcctgctcagtacgatccagtgtattacatttgcaggtattttgcagatttataagaaaatcatggagcattttcagatcacgactgcgtgcgtgatcaccagagctgatactttagaggcggcaaaagagaaaataagggtgcatgactctgtttttctggaagatctgccgtctgacgagcggaatgaactgctcaagttctgttactatatggacaggcaggtttactgcaacacaaaattatcggatattatgatacgcggttcaggattgacacagtatcacgattcaccggtctttttctgtaaccattttggaatggaaatttccaagcgtgcggtaaaaagatgctttgacctcgtcttttcggtgttgtttctggtgattctttctccattgtttttgattattgcaatctgcattaagtgcgaggacggcggcagtgtgatttaccggcaggtccgctgtaccagagacatgaaaaaatttgaaatttacaagttccgcagcatgatcacggatgcggagaaaaacaggggaccgcagcttgccacaaagcacgacaaacggctgacacgggtaggacgtttccttcggaatacgaagttagatgagctgccacagcttgtaaatattttaaaaggtgatatgagttttgtaggtccaagaccggaacgaccggaatttattgtaaaagccgttgaggacatcccggagtttgtactccgcacgaaggtaaaagccggactgaccggatatgcacaggtgatgggaaattatagcacaagttttctggacaaactgaaatgggatctgatgtatattgaaaactattccctgtttctggattttaaaattttactgatgactgcaattgctatttttgcaaaagacaatcacgaagatttttcaaagtgggatatgctctgaaaatattgacaaatgaatttcatatgttaaaataaatcatgttaaaagcataaaatatgacgttgacgaggagtattaagaacgaaaaagtgtcagagagctgtcggatggtgcaagacagtatttggaagttcccaactcgcctctgagttttctgattgaaatgaaaaaataagtaggtcagaacgtgtgattcgcgttaagaatgtgagtgcgtatttggatgaaccgttcatcctgcgaatgagagtggtaccacggagtgaacagatatcttcgtctctttttggagacggagattttttatgtaacaggaaactttgttctattaccacaaaatccacaaaatcatgaatcatgcttgataaaaaagaaggaggaataccatggcagaactttataaccataaggtagtcgaaaaaaaatggcagaaagtctgggatgatgagaaagctttcgcagcaaccaatgactttaccaaaccaaaatattatgcattagttgagttcccgtacccatcaggacagggacttcacgtaggtcatccgagaccttacacagcacttgatattgtagctagaaagagaagaatgcagggatacaacgtactctatccaatgggatgggatgcattcggacttccaactgaaaactatgcgatcaagaacaagattcacccgaagatcgtaacagagaagaacgtggcaagattcaaagatcagcttcattcgctcggttattcttttgactgggacagagagatcaacaccacagatccaaattattataaatggacacagtggattttcttaaaactttttaaagcaggtttggcttacaagaaagaaatgccgatcaactggtgtacttcctgtaaagtaggtcttgcaaacgaggaggttgtaaacggtgtctgcgagcgttgtggagctccggttgtccgcaaagtaaaaagtgagtggatgttaaaaatcacggattacgcagagaaactaattgaaggattagatcatgtggattatatcgagcgtgtaaaagtttcccagaagaactggatcggtaaatccatgggtgctgaagttgatttctctattaaaggaaaagaagataaacttcgtgtatacacaacccgctgcgatacattattcggtgttacttacatggttgtatccccggagcatccgattattgataagtaccagagtgagatcaaaaactgggatgagatcgtggcataccgcgaggaagctgcaaagaaatctgattttgaacgtgcagaacttgcaaaagacaagaccggtgtatgcattgacggtctgacagcagtaaaccctgtaaacggaaaagagattccggtctggatctctgactatgtattaatgtcctatggtacaggtgcgatcatggcagtaccggcacacgatgagcgtgactgggaatttgcaaagaaattcaatctgccgatgatccaggtggttgcaaagaacggagaggaagtagacatcaatgaggcggcatttacagatgtcgcaacaggtgttctcattaactctgatttcttaaacggactggaagtaaaagatgccaaagcaaaaatgatcgagttcttagaggaaaaaggcatcggaactgccaagacaaattacaaattaagagactgggtattctcacgccagagatactggggtgaaccgatcccaatcgtacattgtgataaatgcggatatgttccgatcgatgagagtgaacttccattaatgttaccggaagttgacagctacatgccgacagataacggcgagtcaccactggcagctatgacagactgggtaaatacaacctgtccttgctgtggcggaccggctaagagagagaccgataccatgcctcagtgggcaggatcctcctggtatttcttaagatataccgatccacacaacgatgaagcacttgcaagcccggaagcattaaaatactggatgccggttgactggtataacggtggtatggagcatacaaccttacatttactgtactccagattctggcataaattcctctatgatgagggtgttgttccttgcccggaaccatatcagaagagaacttcccacggtatgatcctcggtgagaacggtgagaagatgtcaaaatccagaggaaatgtcgtaaatccggatgatattgtaagagaatacggtgcagatacattgagaacttacgagatgttcatcggagctttcgatttaagcgcttcctggtcggaagatggcgtcaaaggctgccgtcgtttcttggagcgtgtatggaaattacaggatcttatgactgacgaagaaggttactccgctgatatggagacaaagatgcatcagacgatcaagaaggtaagcagtgattttgaaaatctgaaatataatactgcaattgcagcaatgatggcacttatcaatgacttttataagaaaaatgcgatcacaaggggagaatttaaaacattaattactttattgaacccagttgctccacatatcactgaggagttatggcagattgcaggtttcgaaggaaaagtttatcagacagcctggcctgaatttgacgaggctaagaccgttgagagttctgtggaaatcgcagtacagatcaatggcaagaccaagggaacactttccattggaaaagacgatgcaaaagaggatgtcattgcaaaagcaaaagaagcgattgcagataaactcacgggaaatatcgtaaaagagatttatgtaccgggacgtatcgtgaatattgttatgagataagaaaaaatgccgtggcggctgccacggcgttttttcttgcataggaaattgcttcctatgcaagaaaaatgctccacaaggatgcgactgatgcgcagaagaattatgcaagctaaagcttgcgcgcatcagcgtcctaccggtaagtcttgtaaaaatgaataaattccgcaagtgatttagaaggcttggttgttgtcttgtatgcaaaaccgacttcacgtttgtggattggaaagccaagtggaatttccatgagagttccgttttccaaatcttcccggacaaagttcttgatgacacatgcaacaccgacaccgatgcgggcaaaatcgatcagaagatccatgtcagaaatatcgatggaatctttgatgataatctgattttcctgtaaataatcatcaatgtactgtcttgtcatattgtttttatcaagcagcatgagcgtggaactctgtaaaatatgatctttctgaatccctcttgctttcaggtttcgcagataatctttggctgcaacgaaaatgtcttcaatttcctccaaaaagtcaaaatgaatatttttcagattttccggtttcccgatcagaccgatatcaattttgttatcttccagcagttttaaggtatcattggtggactggcaggagatggaaatggaaatatgcgggttctgccggataaattctttcaggtaaggcagaagcagatatttgcagagcgtggagctgacaccgatttttaagtgtccgacaccgagctcgatggaacgttttaatttttcttcgcccatagtcagggtctcaaacgcttcactgacatgctcatagagcagttttccctcatcggtcagaacaacgccgcgggaacttctggaaaaaagtttgcagccaacgctttcctccagcttctggatggatttgctgatcgcaggctggctgatataaagctcctttgcagcctttgagatatttccggtgtttgcaactgtataaaaaatacggtaagaggataaattctgattcataaaaactcctttttgttatctgatggatatagtatatcataaaacatagttatggtaaatatgtttattatgtatttgtattataatattacctatgctacaatgaatacaagtaaaaggaaccgtgagaaatgagaatatcacgggaatataaacagagtaattgttttgatgatttatgataacagcagggaatcggaataattacgtgaaggaggagtttatcatgggaatgacaatgacgcagaaaatcctggcggcacatgcagggcttccatctgtaagtgcaggacagttgatcgaggcagaattggatttagttcttggaaatgacattacatcaccggtggctatccatgagatggataagatgaaagtggacggtgtgtttgataaagataaagtagcactggttttggatcattttgttccaaacaaggatattaaatcagcagagcactgtaaatgcgtgcgggaatttgcgtgcagacatgacattaccaactattttgatgtaggggagatgggaattgaacatgcgctgctcccggaaaaaggacttaccgtggcaggagatgtaatcattggtgcagactcccatacctgtacttacggagcacttggagcattctctaccggtgtcggaagtacggatatggcggcaggaatggcaaccggaaaggcatggtttaaagttccgtctgcaatgaagtttaatctgactggaaaaccggctaagtggatcagtggaaaagacattattttacatattatcggaatgatcggtgtggatggtgcactttacaaatcgatggaatttgtgggtgatggaattcagtatctgacgatggatgatcgttttacaattgcaaatatggcgatcgaagcaggtggaaagaacggtattttccctgtggatgaccttgcaaaacagtacatggaagaacattccaaacgtccttacgttgtttatgaagcagatgaggatgcggaatatgatgcggaatatacgattgatttaagcaccttaaaaccaaccgtttcatttccgcatttacctgaaaatacaagaacgatcgatgaagtcggagatgtgaaaattgatcaggttgtgatcggttcctgtaccaatggccgtatggatgatcttaggattgcagcttccgtgttaaaaggcaagaaagtgaaaaaaggacttcgcgtaatcgtgattccggcaacacaaaagatttatctgcaggcaatggaagagggactgttaagaacctttatcgaggcaggagcggttgtcagcacaccaacctgtggaccatgtcttggaggatatatgggaatccttgcggcaggcgagcgttgtgtatctacaacaaaccggaactttgtaggtcgtatgggacatgtggattcggaagtatatcttgcgagcccggcagttgcagcggcaagtgcagtcacaggtaagatttccagtccggaagaggttatgtaaaacaagggaggctaaatcctctgctcaccagagggttcgcattttgcttcgcaaaacaaggaggattatatgaaagcagcatgtggtcatgtatttaaatatggagacaatgtcgatacagatgttattattccggcaagatacttaaattcttcagatccgaaagaacttgcaacacactgtatggaagacattgacaaggactttgtgaaaaatgtaaaagagggagacattattgtagccaataagaattttggctgtggatcttccagagaacatgcgccgatttcaattaaagcggcaggcgtaagctgtgtcattgcagagacatttgcgagaattttttaccggaatgcgatcaacatcggattgccgatcatcgagtgcccggatgcggcaaaagagattgaagcaggcgatgaggtggaagtgaactttgatacaggtgtcatcaccgacaagacaaaaggaacttcttatcaggggcaggcattcccgccattcatgcagaagattatcgactgcgaaggtctggtcaactatatcaatcagaaataatttcaaaatacaatcagaagcaggaggactgttgcataaacgatcaggtttgtgtgacggtctttttgtatgttgcgaggtggctgtaaagatatttcaggcattgcggttaagcgaatgttttcagataatcgatatatttttttgagatttttacgtgggtgtagagttcggcatattctcttggattcagcgtgtctacatagttctccgggaactgctttgtcacaccgaatgtttttgcaagatcggcagctttattataagcaacggcagcactggcttcgctggcatagcttccgattttgtaattgccgttaatatggataaaaactttataatgcgtagcaccgtttttctcatagctgaaaacaccatgataacggttgatgttcagaatgttggaataacggaaatcatgcgtatcaccgttaaaaaacagatagtctctgccggtaactgcatagggtttgatcccgtagcgggacaaaatggagtactgcatgccataatcgcttacaaataaatgtccctggcgtttctggatgcgatgaccggcataataaaacagatcatcaatgtcaaatttcagttccatatcatcggaaagaaaataactgaagtagcctttgcgcagataaatagggttatgaaaatacagatgattatcccggaagtttaaaagacatactgctttgtcaaaggacagatggcgaatctgactgtggatgttaaaaagtgtgactgcttcattttccagaaggctgcaggcttctgaataggcagagtgcgcatcatcttccgatgaaaaactgccgagactgatgtgctttgcctgatatgtaatattcgcacggtaatagatggttccgtcctttttttgggcagaataaactccagtttgcatgttatagttttccttccataaaatgattactttacacttatgagatgatatatgctattttaacatgacagaacaggaagaacaagaaaattatggtgactgttcgctcagcagaaaaacacttactgttttgctgtgtaagaaagtgattcagaatatggtaaaaatataaatttgatatgctgtaaaatattgtttcgtaagtaagaatttggtataatattacaaagtgattttctgatcaaaattgtaattggaatttgaaaaggggaaaactaacatgagcgaaagaacgaacggaaaacaaaagaaaaacggaaaagcaggaggcgtaaagttacagagccggatgagccggaaagttttgatccctgttatctgtcttgtgatcattgcaatgttatcttctgtgatcggacattggaatttaaagtccatgtatcaggcgagcaacgagatcacaagtgtttatatgacaaaaacagcacagttgaatgagatctcggataaatttaaggaaatggagatccttgcttacagtatgtgtgtgacaaagtcgacaaatgaccgtgccagtatgctcgaacagagcacagcaaccaaggaagagatcaatagtctgttagaacagttagatcagatggcagtgacagaggatgagaagagcagggtgcagaatatcaccgcttattatcagggctttacggatgcataccagaaggtgacggacagtattgagaatggtaataagacacaggcacaggaatactgtaatcttgaactttttaaagcggcaaataaattgagtgatgaacttgcgtcttatattgaattttacaatgcagatgtagaccgggtggttgcaaaccagagtacggtatatgacagtggaaattatgcaaatctgatcgttatcggacttattgttgtgagtctgatcgcatcgttgtatataacgatctttaaagtagttcgtccgatcaggaagacgtcaaaggaactgaaagtgatcgtcaaagatatgcagtccggtcatgcagatctgacaaagcgtgtgaccgtaaagggaaatgatgagatcgcagaacttgcatccggtatgaatgtgttccttgacaccttacaggaagttctcggaaaaatcgcaacaaactccaatgcgatcggagatgtcgtccagaatgtcggaaggagtgtggagacagccaatacgaatgcctatgatgtatctgctgttatggaagaactttctgcaacaatggaggaggtttcttcttccgctgcaaccgtgaccgataatatttcaaatgtaaatgatgaagttatcagcattgcggatgattcgaaggcaatgaatgattatgcatccactatgcaggagcgtgccgaagagttaaaacagaaggcagtaaacaatcaggaaaatacaagccggatgatcgccggcatcatcgagtcgctgaagtcggcgatcgaggagagtaccagtgtcagacatgtcaatgaactgacagaagagattttaagcgtatccagccagacaaaccttctcgcgttaaatgcttctattgaggcggcaagagcgggagaggcaggaaaaggatttgcagttgtggcagatgagatccggaaacttgcagattccacaagagagacagcgaataatatccagagtatcaacgcacaggtcacagatgcggtggaaaagctttctgacagcgcaaaccagcttgtcacctatattgatgagacgatcatgccggattatgacagcttcgtaaaaacaggcgagcagtaccggaccgatgcaacttatgtcaatagtaccatggatcacttcgaggagcgtgcaaacagtctgaaagaggttgtccttgtgatgaaacagtcagtagaggatatttccacggcgattgaggagagtgcgaaaggaatcgcaaatgctgcggaaaataccgatatccttgtagaaaacatggataaggtcaagaagaaaatggagacaaaccagcagatcagcgatcagctgaaagcagaatcagatcgttttcaggggatttcggacaatttaatgctttaatgcattgacatgagagaacgttttatctataatgagcgaaagagagaaaaaggataagaggattgtgaaaatggaattgatgtacacaagcaccagaaatgcaaatgaaaaagtgacagcttcacaggctattttaaaaggacttgcagaggacggaggattatttgttccggaacagcttccgacattggataagacggtagatgaacttgcaggaatgacttatcaggaaacagcttatgaagttatgaagaagtttttgacagacttcacggaggaagaattaaagaattgtatcaatgcagcttatgacagcaagtttgatacagaagagatcgcaccattggttcaggcggacggagcgtattatctggagttgttccatggctcaacgattgcttttaaagatatggcattatccatcctgccacatttaatgatcacatcagcgagaaagaatcaggtgaaaaatgatattgtaatcctgacagctacttccggggataccggaaaagcagcattagccggattcgcagatgtaaagggaacaaagatcattgtattttatccaaagaacggtgtcagcccaattcaggaaaaacagatggtgacacagaagggcgataatacatttgttgtaggtatccatggtaactttgaccaggcacagactggtgtgaagaagatttttggtgataaagaaatggcagcggaattagcagctgcaggttatcagttctcctccgcgaattccatcaatattggacgtctggtgccacagattgtctattatgtatatgcatatgcaaaattatatgcaaatggtgttattggaaaagatgagagaatcaatgtcgtagttccaaccggtaactttggtaatattctggcagcattttatgcgaagaatatgggaatcccgattgcgaaactgatctgtgcatccaatgagaacaaggtcctttacgacttttttacaaccggaacttatgataagaacagagaatttatgctgacaagctctccatccatggatattctgatttccagtaacttagagcgtctgatttaccgtattgctggaaatgatgctgcaaagaatgcagatttcatgaaagcattaaatacaaacggaaagtatgagattacgcctgcaatgaaagaacagcttgcagatttctatggaaattatacaagtgaggaagaaacagcagaagagatccggaacttatacgagaagacaggttatattattgatactcatacagcagttgcgacaggtgtatatcataagtatttaaaagatacaaaggatacggacaccaagaccgtgatcgcatctactgcaagtccgttcaagtttacaagaagcgtgatggatgcgattgataagaagtatgatgcaatgacagattttgaacttgttgacgaactgagcaaaattggaaatgttaagattccaaatgccatcgaagagatccgtaccgcacaggtaagacataagaccgtatgtgaagtggatgagatgccaaaggttgtaaaagaatttttgaacgtgaaatgatcgtgcagatttttagcatttgtatcttattaaaacgataatagaaaaaataaggctgtctgataaaactatcagcagccttatttttgtgacctgaaaattgattttctattgatacaattccattattatttcttcaattcaaaaatgaaattaacaacaccaaacggatacatgacctgaagtaaataagatgaactggacaattcaatcaattcgtcagaaacaacttcaggagcctctaatgttaattcttttccgagtgtatttgaaatattcacattatataatccgttatgaagatttaagaaatcttccagagaagcctgaacgtattcatcaaactctgtaaattcctcatttacgtatctggatgcaaagctgatacaggttgtctcaggcatatccagataaactttagcggataaatcgccatggatcgtctgcgaaacacagtaatttacaggatactctttgcatgggttaaaacacagcggagtgaaatcatccccgataaaacgcgtcagatcattgaacagcaatcgcatataggaagcattgtattcgtctgcagctacatcagttgtatggaagaaatttgcaagaatccggtcaagatcatcctgtttttcgttgctgtaatctaaatccgttaattcattttcggattcataatccgcaatcagtgtttccaactgcgcattgttaatataaccttcctctacaagtgtctgtcctaataacagaaagtccggatactgtgtcttgacaagttcatcgacctgttcctgcgtcagatatccctcgcggacagccagatcgccaaaccgacaatcgttatgtgtctgtgaaatgatgacattatctacttcatttgcagtcatatatcccttcataatggcgagagtgccaagcttcatatgctgggaggattttttgccaagggcactgagcagctgatcttttgtcactacattgtgagataataaaaatgttccaaaaaactgtgcgtacatattttatctcccttcaaatcttgaggtaaggatgttgtgcagctgctctggatttaaaggcttctggataaaatcctttgcaccggcttcaatggcggaacgcagctgtgactgtgttccgacagaagaaacgataatgatctctgcgtctttgtcgaaatcaataatttcacggattgctgcattgccatcttttattggcataacgatatcaagaaacgataaatcaggcttttcctttttatagatatcaattgcatcctgtccgttggatgcctcgaaaaaagttggtgtaccatattttgaaataaaatcttttaactgcttccgtgcaagtatggaatcatcactaataagaatttttgcattgtctagtctcatagtaaatccccttttcctaatttgtttatagaacctattttacactaaaaaaaatgggcatgcaattgtaatatacaaaattcgtgttgttttttctcgaaaaaacgcaaaatatggattgattttgttcttgaatcttaaggatggagagtttataatgagtgcatctttgtaaaattatgtaaaatcagaaatggagagggtaaaagaagatggatgtaatgcttgtattcgatgctgttgttgcattgtttggtgcctatatgatagggtcagcgcttcatatgaagaagagtggcaggatcaattccatggtgctggcacaggaagagttaaaaaaagtgaaagatacaaagggatttattgaatttctgtattggcgtgaaatgttgtttggtgcattggtattgatcgttggggttcttggagtcttaaatgagaccgttatgccgattggaaaagcaagtatcctggaagtgatcatttttcttgcagctttcatctggtttcagaattcattggcgaaagcgagagagaagtttttacatttataatatgagttacataaaaaacagttgtcatggaaacagaccggaaccggtaatatccggtgtgttcccagtggcaactgttttcttattttaacgttcatccataggaacataagcttttcgttcgccaacattcttgtatgcaggacgcatgatcttgccgctgtgtgccacttcctcaagacggtgtgcactccagccggagattcgtgcaatggcaaaaatcggtgtgtaaagttctaccgggagtcctaacatactgtaggcaaatccactgtaaaagtcaacgtttggactgacacccttgtagatcttgcgttcttttgcaatgatctcaggggcaagccgctcaaccgttgcatagagattgaattctttttcatatcccttttcttcggagagcttttctacgaaagaacggaaaataacagctcggggatcggaaagcgagtagactgcatgtcccataccataaattagaccagcgtggtcgaatgcttctttatgcaataattttgtcagataatctgcaatctcatcctcgtttgaccagtctttcacctgttttttcatatcatcaaacatttttacaactttgatattggcaccaccgtgtttcggcccttttaaggaacctaaagaggctgcaatcgcggaataggtatcggttccggaggaagataccagatgtgtggtgaacgtcgagttgttaccaccaccatgctccatatgcaagatcaaggcggtatctaacaatttcgcttccagtggtgtaaatttactgtcagcgcggagaatatgtaaaatgttttctgctgtagaatattcttctttcggaggatggataaataagctggcaccatcgtgataatgcttatatgcctgataaccgtaaacagaaagtaatgggaataaactgatcaactgaagacactgtctcaatacatttggaagagaaatatcatccgccctgtcatcgtaggagtaaagtgtcaacacactccgcgcaagggtgttcatcatatccctgctcggcgctttcatgatgatgtcgcgtacaaaactggtaggcagtgtgcggtatttgctcagcatgctcgtgaattcttttagttcgtcttttgttggaagactgccaaacagaagaagataggtacattcctcaaatccaaaatggcttttctcgtcaattccggcgatgatatcttttacattatagccacggtaatagagttcaccatctgccggctgggatactccgtccacgatctttgtcgaacatacatcagaaatctcggtcagtccaacgagcacacctttaccgtttatgtcacgcagcccgcgttttacgtcgtatttgctatataattccggatcaatgacagaacatttggcacttaactcagacagatgctctaactccggtgttatctcacaaaatggattattttttgtcatttaaagccctccttcaatttatcacgttaacttataatagcatatgtactaaaattaatacaagaaaattgttccaaatttaaaaaaatttaaaaaatttttagaaaaagtttacatataaacatgaaacttcttaattattcctatactttcaggagatattagattacaataaaaaatgtaaataatatgtcgtttgttggaaaaaacagtataaaaatggaaaaacaggagtttgacaggatggaagcggaagagttaataaaagcagctatggaggcaaaggagcatgcgtatgtcccatattcccattttcgggttggagcggcacttctaacaaaaagcggtaaggtttatcagggatgcaatattgaaaacgcaggatattctccgacaaactgtgcggagcgtacagcattttttaaggcagtctatgagggagagcgtgagtttgcagcaattgcgatcaatggagatggagacgattatctgtatccgtgcggtgtgtgcagacaggtcatggcagaattctgcgagccggatacgtttcgaatttttgtttccaaaaagaatggagaatatcgggagtatacgcttggggaattgtttccgggtgcattcacaaaggacgatatagaaaaagccagagtttactaggtggaacatgtttttgccattttgtcaatggataaaactacaagaaaatagtagtaattttggtagtattttttacgttccggcattaatttttgcttgtgaatcagggaacattaaagtataataagactatcaaaaaacagcctgggatgtgcgacaccctactattttgaacctacatttactttaaacgggattccaacattttcaattggatgccaggcctcagtaattcgctacggcggcgggggaaggcaaaagcttgattgaggttacccacctagcgttggctaggagtcaaaattgtaggaaacggcattttgggtattacgaaagaattagggaagtacgaaagaatttggaagtacagaagaagttttgaagacacaaaagcgtttacaagacacagaagattcgtagtgaagtacaaaagatccatagcgggtacagaagaatcacagtgaggtacaaaagatccggaaagtacaaaggcatttttgatcagatacaaaagaatcataaaagtaccaatgaagatagaagttacacacgagaataaaacagaagatacaaaagcgagaagctgctttcttagaaagcagcttctttttaggtagtgcgtgagggggaaagtgcatttgaaaagaaaaatcggactgcttgtcattttgttactgatattgtctggcatgctatttgcaggaacgaaaaaagggtatcataaagacgtttattcagaacacaatgtttcggtggaagaggtgcaggatgaactgtctttttctatatataaggagatagactgggaacggatattgtcacagaaacaggagtatctgacaaaaaaggctgccagcgaaattttagagtttcttggattaaaggattacatacaacttccagagaaaagtgagaacgctgcgctagaccgcggggagtggaacgctgtttatacagaaatccttgcttatctcgatgatgaaaaaacagttacaacacaggatctgttgctgatggatgtgattgaatcggacagcggatgcattctggtcacaaatgagggggattatccatcaaagtttggacaacattttctcacagcatgggataattaccgattgtatttgctggatggtaaatgtgttggaattgcgggaatcagtgaagaggaagcagaggtatataatacttatgtcaaggctgtcgaagatggaacacttacttttttatacggtggtgcagaatatgagattacaatggatgcatcggaaaaagatgtgacagaaggcgtggcggatcttgttttttcaaatggaaagctccagatcgtgcgaaaaaaagaacaggagatcggtggaaaattattgtcctatgatgaaaatacgatagagattgaaggctatggaagagtctcccataccgggaagatcccggtttatgaacttttagaaggggaagatgtcacggagagttcgatttcgaaagtggttctcggaaacatggaagtatcctatgtgatcggggaagaagaagtctgtgcaattttgatcaggacaccggcagtaatcgaaaatatccgggttctgttactggcagacgatggtggaaaattccgctccgcagtttatctgaaagcagatgtggatgcaagtattaagtttggtgaaacagtgtcagattatgcggcgggaacgctgcttgatgtaagtacatggtttacagaacgtgatgatacattttccattcagcctgcgacggagactggaaagatttttctgtgtgatgaagtgggaaataccatctcaaacggatattccggcagtgtggaggtgcgccgttacgaggagggctacaccgttgtgaacagtgttccgtttgaaacttatcttaccgcagtggttccaagtgagatgccatctacctatgaaaaagaggcgctgaaggcgcaggcagtctgtgcgagaagctatgcctatattcagcttatgagggcagatctggcggctttcggagcacatatcaacgacagtacatcctatcaggtttataacaaagcagaggcgggagaggcatccagacaggcggtggaggagacaaaacatgaagtgatgacttatgcggacgaagtgatcgaggcgtattatttttcaacgtcgatggggtacactgacactgcagaggtatggaatccggaagagatggatcattatggttacctgaaaaaagtatgtttgaacacaccggagacggatcttgatctgtcagatgagaagacattttcagattatatccggacaccgcatacaggatttgacagtgagatcaagtattatcgatggacagcacaggctgacttccatggaaaagaagacgaaatccggcagattttggaaaacagacattccatttctccgaggaacgtgatatattatgaatctgatggtaaaaacgagacggattccatggcagattttggaatgctcgaaggcatcgaagtggagaaacggagtacatcgggttccatcctgacattacggctttcctatgaacatggaatggtaaaagttttttccgagtataatatccgtaaagtcataggacttggtgtgacaaatatcacgtatcaggatggaagtgagagcactggagggacgatcctgccatgtgcagcggtcagtctcgtaaaagaggcagataatgtttacactctgtatggcggaggttatggtcacggacttggcatgagccagaatggtgccaatggtctggcgaaaaccgggatgacttataaagatattttgaatttcttctataaggatatctcaatcaccagtctgacagaaaaatgatctgcgtatcaggaagatgaagtgcggagcaaacacaaatttacttattataaactacagtaacaatggaggaaagaaaattgatctggaagattatcggaaacggaaaatctttttttgataaatgtaagcgggataagatcaatgcatattctgcccagtcggcattttttattttattatcgacaattccatttttgatggtgttttcttcccttcttcaatacacaccgatcacggaggggactttgttaaaaatgtatcagactgcattgccagattacatttcagcttttttgatttcaatcacggatgaagtatataaccgttcggttggaatcatctccattacggcgatcgtggcaatctggtctgctgccaagggaatccagtatatgacagatggactgaattcggtcaatgacctggaggaaaaccgcaactggtttgtgttaagactctgggcaatcgtctatacgatcgtatttttgtttgcggttgtatttacactggttgtcctggtctttggaaatacgctgcatgatcttgcggtagagtatattccgctattgcagagtctgacggatctgatcgtaagacttcgtggctttgtgctttttggaattttatttgtattttttgatattatttttaccatgctgccaaacaaaaaactgacgtttaaaagccagattccgggtgcagcgatctgcgcggtggcgtggtatgtgttttcgtttgctttgtccatttatgtggattactttaatggattttctatgtatggaagtctgacaacgatcgcactgatcatgctctggctgtatttttgtatgtatattatgatgatgagtgcagaagtgaacgtgatcttcaatgaaagcttccggaaatggctcaagcgtgaccggacaaagaaaaaaaggggttgagttttagaaaaccctgtgatagaatagcaattgaatttgatgctgatcatgggcatcagaaatagaaaaggctatgaatgtgtcagtagagcactatactttttaaagagagagcaggtcaccggctgagagccagcttaaggtaagataggaatcgaatttcacacaggagccgcatttgtgaacgcaggagatcttgtaaatagcagatgacgcctgatacacgttacgtatctacaaagtgcttttcttcggataaagaagagaagaatcagggtggtaccgcggaatcattcgtccctaagtgagggagaatggttccttttttatgtcctgaaagatgctttgggacaattgcgaaactcatgaaaacctaaattgaattgtaaaaaattgacaaaagacatgaaagacactggggagccgccggtacttagaaggctggtgcgatgcgaatcgtgcctgacttcttagtaccgctgcgagcgacacgtagcgagagcgtgtcttgaatgtttttgttaattttgaacaattgaaagaagagtatgaggagtttcgcaaacgcctagaagttgtttatgaaaaaggagaaatgaaaatgaaagacaaattgcagcagatcagagagaaagcaattgcagagatcgagggatctgacggattagagcgtctgaacgaagtcagacaggcagtgcttggcaaaaaaggtgaacttacagcagtattaaaaggaatgaaagatgtagcacctgaagacagaccaaaagtaggacagtgggtaaacgatacacgttctgcaatcgagacaattctcgaagagaaaatgaaaaaattagaggcagatgccttaaagaaaagatatgaagcagagaaaatcgatgttacgatgccggcagtgaagcatgaaaaaggaaatctgcacccggtgacacaggtccgtaaccagctcattgatatttttgcctctatgggatttgaagtttatgagggaacagagattgagacagattactataacttcacagctttgaatacacctcaggatcatccggcaagagacatgcaggatactttctacctctcaccggaattcctgctccgtacccagacatctgcaggacagatccatgttatggaagcaaagaaaccaccaatcaagattatttcccctggtaaggtattccgttccgatgatgatgcaacacattccccaatgtttacacagatggaaggtcttgtggtagataagggaattacactctgcgacttaaagggaatgttagatgaacttgtaaagaagattttcggaaaagagacgaccacacgtcttcgtccatcctacttcccattcacagagccttccgtagaagttgatgtaagctgtttccagtgtggcggatgcggatgcaaactctgcaaaggtacaggatggatcgaagtattaggagcaggtgttgttaacaataaagttttagagggttgtggaattgataccaatgagtacagtggctttgcattcggtatcggtattgagcgtatcgcaatgttaaaatatggtatcaacaacatcaaattactgtttgagtccgatatgcgtgtattaaaacagatcgatgactaagacaaacagatagagataaaagaaaaggagacttatcatgttagcaccattaagctggttaaaagattatgtagatatagatgttactccaaaggagttagaggaaaaacttttttcctgtggatttgaagttgaggaactgattgaagttggaaaagatatcagtggcgttgtcgttggtcttgtagaatcctgcgaaccaattccagagacacatttaagcttatgtcaggtcaatgcgggagagcatggaacattccagatctgctgtggagcggacaatgtccatgcaggcggcaaattcccgctcgcactcgtaggcgcaacagtttatgcaactgcaaaagaccatgtcacgatcgaaggtgtgatgacaattaaaaaaggcaaactccgtggatatgaatcctttggtatgctttgctccggaacagagcttggattaaacgaagatttatatccgggcgcaggatacaacggattacttgtgttaccggaagatgccagagttggagcagacgtaaaaccgatccttggaatggatgactggatttttgacattgcgatcaccgcaaaccgcccggactgccagagtatttacggtatcgcaagagaagtagcagccgttctcggaaaagaatgcaaagagcctgcacttgatttcacagagacagatgtaaagaaggatttccatgtaactgtttctgcgaaagatctctgcccgagatatatcgctcactatgttcatgatgttgaaatcaaggaatctcctgcatggatgagaagaagactggcattagtcggaatcggtggtatctccaatatcgtagatatcacaaactacgtcctaaaagagttaggtcagccgatgcatgcattcgactatgcatatttagagggtgacgagattaatgtcagacgtgcagatgatggcgagaagatcacaacattagacgaaaaagaatttgaattaaataattcaaatcttgtcatctgtgacggtaaaaaaccggttgcactggcaggtattatgggtggtttgaattctgaaatccaggacaccacaaaagaagtgatgttcgaggctgcaaaatttgcccgcgacaacatccgtaaaagctccagggcactgggacagtcctctgattccagcgcaatgtatgcaaagggtgtttacgaatacacaactgttatggcaatgaaacgtgctcttcatttagtagaggagttaggctgtggtaaagtttcttccacacacattgaagtgtctaccggaaactccatcgagccaaaagagatgaaagtaagtgtaaaacgtgtcaatggggttcttggaatcgaagtcccagatgctgacatcgttcgtattcttactgctttaaattttgcaccggtcatcaacggtgatgagctgacattgcagattcctgcttaccgtgaagatatggattcttacccggatgtggcggaggaagtgatccgtatgtatggctatgagcatgtaatcccaacctttatgccgactgcgaaagtgacattaggtggattaaacttaaaacagaagacagaacttaaaatcaaacgtgcactctgtgcagcaggagcttatgagggaattcattactccttcttctcaccgtctgatctggatctgttaagactgccggaagatgcaaaagagagacatgcaatccgtctgatcaatccaattaatattgatctttcactgatgagaactacacttgcaccgcagatgatccatgcgatggcaagaaaccagaaaaaagcaattttagagggaagaatcttcgaacttggaaatgtatttattccaaaagatctcccacttacggagtatccggatgagagagagacactgtgcgttggattatttggcgagaaggaatctttctacacattaaaaggatttgcagagacggttgcagatgcactgaatattacattcacatacgaggcagccgagaatacattccttcatccatatcagacagcagagattttctgtgagggtgagaaagtcggatatcttggaaaggtttcttacgagatcatggatgaacttgatatgcgtgtaccggcttacgtcatggagattgatcttgcatccctgaaaaaatggtatggaaaagagcagatctttactccgttgccaaaatatgcagaagaaaaacgtgatttcgcatttgtggtagacaaaaacatcacctgtgcgcagattgaaaatggtatcaaagaggcctgcgattatgtcacagatgtaacattattcgatgtctacgaaggaatccagcttggaccggataagaagagcatggcattctcagttgtatttactccggctgacgaagaattcacaacggaaagagtggaaggttttgtcaagaaaatcttaaagaacttagagaaaacacttgatatcaggcttcgtgcataatatgatagaaacatggcaaagagtcgcagcagcggctctttgttatgtacagaaaatgctaatagatggagaacaatcatggatgtaaaagatttttattatgatcttccacaggaactcattgcacaggatccattggaggatcgttccagctccagactgatggttttagataagatcacaggagaagtggaacacagacattttaaggatattacagagtatttaagaccgggcgactgccttgtcattaataacacaaaggtaatcccggcacgtctttatggcgtgaaggaaggtaccgaggccaaaatcgaaatccttctcttaaaaagaaaagaaaatgatatctgggaaacactcgtaaaaccgggaaagaaatgcaagatcggaacgaaaattgttttcggcgaagggattttgaccggtgaagttgtcgatattgtagaggaaggcaaccggctcatccagttccattatgaagggattttcgaagagatattagaccggcttggccagatgccgctgccaccgtacattacacatcagcttcaggataagaaccgttaccagacagtctatgccaaatatgacggatccgctgcagctccgacagcagggcttcatttcacaccggaattgttgcagcaggtgcgtgacatgggggtagaaattgcggaagtaacactgcatgtcggacttggaacgttccgtccggtcaaggaaacagatgtgttaaagcatcatatgcattctgaattttataaaatcgaacagtcagaagcggataagatcaataaagcgaaaaaagaaggccaccgtgtcattgcagtgggaacaacaagcaccagaactttagagtctgctgcggacgagaatggtttcctcacagaaaaaagcggatggacagaaatttttatttatccgggatatcagttcaaagtcatcgatgcactgatcactaatttccatctgccggaatccacactggtaatgcttgtatccgcacttgccggaagagaacatgtactggcagcctatgagaccgcagtagaagaaaaatatcgttttttcagttttggcgatgcgatgtttattgtagaccgggagtcttaaaactacttgtaatcgcaaagaacttgttatacaattatcttaaatatttcatgaaggagaagtgaggtatggaggagcggagaaagcataagagacttgatctggaagtcatggttgaattagaacgattagatgaagaaagcgtgaccactttgaaatatgtccatgtcgaggtgacagatatttcaagaagcggtctcggatttaagtcgaaggcagatcttgagattgggagctattacgatacaaggattcagatctggacgaaagaagttgtggatgctgttattgaaatcgtccggagagatgctttgccggagggcggttataaatatggatgcaggtttattgggatgacggatactgacgcactcaagatagatatttaccagatatttaatgatctgtaaaagaaccggggatccgatactacaatgcaggagtatatcgctatgtcgtttcaaaaaataaaatcatctacatcacggtgttttgatatcagcacagcagcattgcatatcattgcaatgctgttcatgctgatggatcacctttgggcaacacttcttccggcgcaggaatggctgacctgtgttggcaggatcgcatttccgatttttgcatttatgtcggtagaaggttattttcatacccataatttcaaaaagtacttattgcgaatgctggtttttgcagtgatctcagagataccgttcgatctgatgtatggtggaacatggttttatccggtccaccagaatgtgatatggacgtttgtccttggtcttttaggaatccatataatggaaacagtgcgaaagaaaaagaaaacacctgtttttgtactgacagccatactggttacgattgccggaggtttactcggaacattgacaatggtggattattatggaatcggtgtactgactgtttttattttctattttttccgcggacgcaaatggtggtgtctgcttggtcaaattgtggctctttattgggtaaatgtggaattgcttggcggattaatgtatccggtccgtttgttcggcatggagtttgaactttgccagcagggtcttgcattgcttgcattagtgccaatctggctgtatcgtggacgacagggatatcacagcaaaccattccagtatttctgctatgcattctatccggtccacatgctcattcttgtgctgatactgggctttgtgaaccggtgatctgtctgatgttgactggtcaggagaatatttttaatttgttgtctcccggcggataaggataggcgtaatttgtttatggatcggttctgccagcggaactggttttctctttttacgttcttccatctgctgcactaataattccatggaggtgtgtgcgatcacatcgatttgctgtccaatggttgtgatcggcaaaatagcttcactggcaatcggagagttgtcaaaccctaccagttcatatgtgtcagggagacatccatatttttgaaagattagattcaggaacatatttgcataggtgtcgttcgcaagaaagacaccttttttttgaccgggatatttttcatcgatatcagcaaagatgattttcatttgtgaaaagagctcctgataagaatctccacacacattaagatttaattcataaggcacatgatgttctttacaggtgtcttcaaatgcacgaattctgttgtaggcaggaataatctttggcacatctgcattaatatgaatcagcacatcacaatggtcacggatcaaaagtgatgcagcctgcagagctcccatataattatcagttgtgacactgcagatatgttctgcctcacgttcaattgctatgacaggaatctgataagaagcaagcttttcggaagaaagcgtatggcttaatacgatcaggccttcgatctgataagacatcaattcttcaatatactgctcctcctcatccggtccgttatcactgacaaaaacaagaaatttataatgataatcacggtagctggaaagaagctgggttaacatttctgagtagtagtgaaggtaaagatttggtacgataatcccgataaattcacttttcccatttgcgagcacctttgcgagtttgttctttttatatcctaaatcctcaagagcctgagatattttttcctgattttcaagtgtcagtgaatccggatgattaaaatatcttgaaattgtagttttggaaaaatgcgtgtattctgcaatgtcagcaaatgtcacttgttttttcgccataagtatctgtctcctttacgcattgtctattgtatttatcagtatgttaaaatatgaatcgtttcgttacagtttcatattacacatagtatagcaattaagttctggaatatcaataaaaaaataactggttacgtaactggttactttaacttaaaaaagtgttgacatctattggaaaataggttattatccaattataaagtaaccggttactttaccgattatacaacaagactaaatggaggaatagtgtatgaaaagagggttgaaaccaaaaaagtctacaggcagacaaacgcttgtaagtaaagtttcctatgtcaaaagaaactggcagctgtatgtgtttttcctgatgccggcattggtgttaacaattatatttaagtatcttccgatgggtgggctgctcatcgcattcgaagattataatgtgatcaaaggtgtttttggaagtccctgggtagggctggaatacttcaaacggtttttatcctcaccggattttatgagttatctgttaaacacattaaaactcagcatttatggactgctttggggttttccgattccaattatcctggcattattactgaaccggatccgtaagcaaggtataaaaaagaaaatacagcttttaatctatgcacctaactttatttccgttatcgtactctgcggtatggtacgtatgtttttatcaccggttggtccgatgaaccgtattctcggtatcactacaaattggatgacaatgccgactgccttcaggacaatttatattgcaagcggaatctggcagggagcaggatgggcatccatcatgtacacggcagctttagccaatgccagtaaagaattagaagaagcggctgttatggatggtgcaaatctgctgcagcaaatctggtatgtcgagttgccggccattaaagatattattgtaattcagtttattttacaggccggaaacattatgagtatcggatttgaaaaagcatatgcattacagacggatatgaaccttccggcatctgagattttatcaacttatgtgtatcggatcggacttctgaacggagattatggctactcaacggctgtcggattgttcaactctgtcattaatgttattttattgattttcgtaaattttgtagtaaagaaaataaacgatggagaaggattataggaggatgaaaagatggaaacatcaagaaaaataaaatattcgagaattgaccgtctgattttaggtatagcatatgcgcttctcggtttgtttgttctttcgattgttattcctttgatatatgtggttctggcatcttttatggatccgactgttttaaataatcagggactgagttttcggataaaagactggacattagatgcataccggcgtgttttagagaatgaaatgatatggagaggattttttaattcatttttctactcgctggcgtttactgcaatttctgtttttataacacttcttgcagcttatccgatgtcaaaaaaagagtttgtcggcagaaatttttttaatgtaatctttctgatcactatgttttttggtggtggaatgattccgacatttatattaatcaaccgtttacatatggtgaatactgtatgggctattttaatacccggagcattcaatgtatggaatatgattcttgcaagaacttattaccagtcaataccaaaggaactcagagaggcgtcctccattgatggtgcaaatgaaatccagcattttttcaaaattatgattccggtgtgtaaaccaatcattgcagtactggcactctggtcttttgttggaatgtggaacagctattttgatgcactgatttatttgaatgatgcagatctgcagccattacagcttgtgcttcgttccattcttgtacagaatacgccacagcctggaatgatcgctgatatccagagtacggctgagatggcaaaagtagcggaacagttaaaatatgcgactattgttgtgtcaagcttaccattattaattatgtacccatttttccagaaatatttcgataaaggaattatggttggatctgtaaaaggttaaagaagggggacttcctatatgcgtagaaaaataaatagaatgttgtcattcgggcttgcactgatcatgatgtttagtatatccggctgcggaagcaatgcacagccacaggcagagatagatccggacactccggtttccgaagtacagtttccgttaaaagaaactgcggaattatcctttattaccagtgcaccggcaacctcaacgcaggatccgaatgaaaggatcatttttcaaagacttgaggaacagacgaatgtgcatattaaatggacgtgttttgtatcggatcagttttctgataaaaaaaatcttgcattagcacaatttggcaatctgccggatggcttgtttaatgccggaatgagtgattacgatctgcttcgttatgcaaagcaggggattattattccccttgaaaatctgatcgataaatatatgccaaatcttcaggctgtatttgaaaaatatccggaataccgcacaatgtgtaccgcaccggatggacatatttattcatttccatggatcgaacagcttggtgtcggtaaagaagccatacaggccatcggagatatcgcatatatcaataaaaaatggctggattatcttggattggaaataccaacaacaacggatgaactggaacaggtattaattgcattccgggatcatgcggatgaattgcaggaagaatttgatattgaaggtgatgtgataccgatgtcctttattatcaacaatggagatcaggatcccgccattctgatcaatggatttggagaaggctatggtgataccggggatcattttgcagtgacggatgaaggaaaggtcatttacacagctgttcaggaagggtataaagaaggcattgaatggctgcataaattagtaacagaagatcttatagatccggaagcgttcacgcaggaatggtctacctatgttgcaaaaggtaaaaaccaccgatatggtctttgcttctcctgggatattgcaaatattgataacaatgttgattatgtaatgctccctgcacttacaggtccgacgggtgtgcggaatatcacaagacaaaacaatagtgagaccagtggttttgacagaggacgctgtgtacttacgaccagttgcagaaatactgcactggcagcagcatggatcgatcagatgtatgcaccattacagtctccacagaacaattggggcagttatggagagacagattcctttaatatttttgaattatctacaaacgaaaaaggtgacccgatgttaaagcatatggatttaggcgaccagtctccggtagaagtccgcgaggcacagtcagtcaatggtccgcttgccatcttaaatgaatattatggtgagtatgtaacacagccggaagatgcaaaatggcggcttgacaatatgcatgagacatatttggcagatatgaacagtaaatacgtttatccgaatgtatttatgagtatagaagacacgaataaggtgtcgcaatatgacacagatattaaaaaatatgccgaacagaaaaaagccgactggattttaaatggcggcatagaaaaggaatgggattcctatcttgaaaaaatggaaaaatatggattatcagattatctttccattaagcagaaatactttgacaactatcagaaatcattatcagaataatcaggagagaaataatatgagcaatatgttagaaaaagccagaaaatacgagacagaaaaaattgctgctacagatccgcagacaaaacctttatttcatgtttctgctccaaccggatggatcaacgatccaaatggattttcgttttacgatggacagatacatctgttttatcaatatcatccatataacagggaatggggaccaatgcactgggggcatagcgttacgtgcgatatgatccactgggaacagcttccagcggcacttgctccggatgaagaatatgataaagccggatgcttttcaggaagtgcgatcgaagcagatggtaaacatgtacttgtatatacaggagtaaccagaataaaacagcctgacggaagtgagcaggatcgtcagaatcagtgtattgcatttggtgatggaaaagattatcagaaatatgacaaaaatcctgtcatgaccggagaaatgcttccagagggatgcaacagggtagatttccgtgatccgaagatctggaaagaaaatgatacctattatatgatcgttggcaataaaaatgaaaatcagatcggacaggttgtgttatgttcaagcaaaaatctgactgactggaaatttgaaacaattcttgcttcaaacgaaagcggaaaaattggtacaatgtgggaatgtccggacttctttcagctgggcagtaaaagagtgctgatctgttcaccgcaggatatgaaagcgcagaaatatgagtttcataatggacataacagtgtttattttcttggggactatgatgaaaaaacacatacatttgtaaaagaattgccgcatgcacttgattatggaatggatttttatgcaccgcagacaactgaactgccggacggcagacgtattatgatcgcatggatgaaatcctgggatgcatgtgtgattccaaattcacaggattggcagggaatgatgacactgccgagggaattggaattaaaagatggtaaaatctggcagacaccggtgcgtgaaattgaaaagtatcataaaaatccatgtcgatatgatcatgcagaaataaatcaggaaacaacactgtgcggaattgaaggtcggacgatcgaccttaccgttttactggaagaggatgaatttcaaacattttccatgaaacttgccgcaaataaggaatatgaaacaagctttacttatcataaggctgaaaatatgcttgagatcgatcgcacttattgcggtgtgacaaaagatgttgtctgcgtgcggaaactgaagatttcaaatccggaagggcttaagaaaatgagatttattttggatcgtcagtcaatcgaactattcctgaacaatggggagcaggttgcgacaacagccatctgtacgccgttggaagcgcagaaaatctatttttacagtgacaaaaagatgcatataaatgttgaaaagtatgatataatgagtgcaagtgagaagaatgcatttatgcattcggcgaacgacgaaattattgagtgatgaaatcacgatatagtaaaattataaaacaaaaactactatcagacacggaggaaaaagtatggatgttgtagctttaggtgaattactcattgattttaccgagaatgggatcagtagtcagggaaatccattatttgaggcaaatccgggtggtgcaccatgcaatgtactggcaatgttaacaaagctcggacataagacagcttttatcggaaaagtaggaaatgattttttcggaaaacagctggaacagacgattatggaagtcgggattgatgcatcaggcttacagaaagatgatgacgtacatacgacgttagcactggtacatacttatccggatggagacagggatttttcgttttacagaaatcctggtgcagatatgatgctgacagaagaggaagtcccggaagagttgataaagggaacacgaatctttcattttggcacactgtccatgacacacgaaggtgtacgaaatgcaacaaaaaaagcgcttcgtgctgcaaaagaagctggtgctgtcatttcctttgatccgaatctgcgcgagccgctctggaactccttagatgaagcaaaagaacaggtgctttacggattaggacagtgtgacattttaaagatttctgataacgagatccagtggctgaccggagaagaagatttcacaaagggtgtacattggatccttgagagatatcatattccattgatccttgtatccatgggcagggaaggaagccgtgcttattataaagatcttattgtagaagtgaaaccttttatacagaagaatacaattgagacaaccggagccggagataccttctgtgcatgtgttctccattatattttagagcatggacttaccgatcttacagaggatggcctgaaagagatgctgacttttgcaaatgcagcggcatccattatcactacacgcaaaggcgcactccgcgtaatgccggaacgggaagaggttgagaaattgttatcctgtttcaattgatactgtgtatacaatatatgagcggcagattaccgctcatatattgtataatgatgttttctaagcaactgtactgctgcatctaatgatattctgtcatacatttccagacgtaatactccatcttcaaactcacggttgtgaatgatgccgatatttttaatactcagatgattgcttgcaagtattgtagcaactgtcgcaataccaccagcctcatctaaaagatctaaatacagttcatatatttctttgatcggacctttgttcgtgatcgcaatcgaatccctgtaatctttggcggactgaaaatcctgaagcagtgcatccgcatcagaagataaaatatcgtgtttggttttctctaacatttcctcataggcatcgatcagccgcacaatctgttcactgttggactggcagatattctgccacataacaggagaggaggaagcgattctggtcagatctttaaatcccccggcagcgatcgtcttcatcgtctcgtctgcgtcgtcggattttttgacaagattgacgagactgtatgcgatgatgtgcggcagatggctgatggcagctgtggcataatcgtgtaaatgatagtctaataccagggcgacagcacctaactgggtcaccagggaacgaaattcttctaagcgttccggtgatgtcttagttgtgggtgtcagaatataatatgcattttccagcaaatattcatttgcattttttaagcctgttttttcagagccggccatcggatgcccgccgataaagcagtcctccattgcgagggcagtcacttcttcgtgaatatctgttttgacgcttccgacatctgtgatgatacatccgtttttgatatttccctttaactggcgcaggtattcgatatttctttttaccggtgtgcacagaaaaatataatcgcagtcataaaaatctttgatctcacataaattctgattggagatcagatgttctccgtaagcttcggtaatggtttcctgatgaccggcagttgcgataatggttacatcagggtaaagtgtatgaattttttttgcaatggaccctccgatcaaaccaagtccgataaatcctattttctgaaacaaatcatgttcccccataagtcatttttgtatatttagaaagtcttatacatcatatccacattttatgaaaaagtcaacacgttaaagtataaaagtgattggttaaagtataaaagcgattagttatttcatgaaaaaggaaaacagaacattttctacgaatatgtacaaattgtgaatattgtgtaaacaatcaaatagaaattgctaaaaatgttcaaaatacatacataatatataaacaatccaatgataatataataatagttagtaaatatgaataaatatattgtaaaaaagtggaaaatttagtaaaatataaccattaacaacatttggtgatgacgaaacaaaatcatcaatgaaaaatgtatgggaggatttgctatgaacgtttacacaactgacaaaattcgcaatgtggttctcttaggccatggaggatccggcaagacaagtcttgtcgaggcaatggcttatcttgcaggaatgacaacccgtatgggaaaagttgcagacggcaacacgatcagtgattacgacaaggaagagacaaaacgtcttttttccatcaacacttccgtgatcccggttgtctggggcgatacgaagatcaacatccttgatacacccggatattttgattttgtaggggaagcagaagaggcagtgagcgtggcagatgcggcgatcattgtagtttccggtaaggcagggatcgaggtcggaacgaagaaagcatgggagatgtgcgagaaatacaaacttccgagaatggtattcgtaacggatatggatattgacgaggcaagctaccggcaggttgtggaagatcttcagcagatgtacggcaagcgcatcgcaccgttccatcttccggtcagagagaatggacagtttgtcggatatgtcaatgtgctgcagcagagagccaagagatggaaagaagatggaaccgtagaaaagtctgatgttccggaatactccaaagacaacttaaatatctgcagggaagcattgatggaagctgttgctgagacgagtgaagagtttatggaacgctattttaacggcgaagagttctcggaggatgagatccgtcaggcactccgcgtgaatgtggcagacggcagcattgttccggttctgatgggttccaacacactggcaagaggaatgtatacattgctggtcgatattgtgaagtatctgccaagtccggaaaaacgttcctgtaccggtatcaatgccaagacgaatgaagtgtacagtgcagattatgattttgcaaaaccaaagtcagcttatgtatggaaaacgatcgtagatccatttattggaaaatactccctgatcaaagtaaattcaggcgttttgaaaacggatgatgtgttatataaccatcacaaagatgtggaagaaaaaattggaaaactgtatgtgctctgtggaaacaaaccggaggaagtaaaagaacttcatgcaggtgatatcggtgctttggcaaaattagcaagcccggcaaccacggattccctttccacaaaagcaaatccgattttgtatattcggacctcaatctccacaccatatacttacatgagatataaggcagtgaataagggcgatgaggataaaatctcacaggctctccaaaaactcatgatggaagaccttacactgaaagcagtcaatgacagtgagaatggccagacactcctctatggaatgggagaccagcatttggaagttgcagtcagcaaacttttaaaccgctacaaagtggaagtcgaactgaagaagcctaagattgcattccgggaaacgatccgcaagaaagcagatgtggagtacaagtataaaaagcagtccggcggtcacggacaatatggacacgtcaagatgacatttgaaccatccggcgatctggaacagccatatgtatttgaacagacggttgttggcggagcagttccaaagaactatttcccggcagtagaaaagggaattcaggaatcctgcctgaaaggtcctgtcgctgcatatccggttgtcggtgtgaaggcagttttatatgatggttcttatcatccggtagattcctcagagatggcatttaaaactgctgcaaagcaggcatttaagaaaggcttcttagaggcttccccggttctcttagaaccgatcgcatcattgaaagtggtcgtgccggataagtataccggagatattatgggagatctgaacaagcggcgtggacgtgtgcttggaatgaacccgacagatcatggttatcaggagatcgttgcagatattccgtatatggaattatttggctataacacggatcttcgttccatgacaggtggaagcggtacatattcttatgagttttcaagatatgagcaggctccgtctgatatacaggagaaagagattgctgcaagagcaagcaaagtagagaaactcgacgagtaaaggaggagatgtggatttatgaagatcacaagaaatattttcataattttatatgcaatacttcttgtgatcaacgatccacaggtcgcacgtgcccatacgatcgaaggaatcggaatctctcaggcaggtatcattgaaaacaaacctgtttatgttgatccgtatgaagaaaccggtcagaaggcatatcatattacctatattctgaatggaggagagaacagcatttccaaccgtgaggtctatcacgaaaaggaacttccggtgacactggatgtcccggtgaaggaaggttataattttgccggatggtatacagacagcagttatacaaagaaggtgacagagatcacaaagaaaagtccttctgaacttgttctttttgcaaaatggacaaagacaatcgacagttatctgaacgttgagatgtattcttatcacaccggaaatctgcttgcgatgaaccagaaagaattaagacagtgcagttataattttatggatgaattatccattccgggaatgccttccaccagagaaaaagattatgtaaacaactatatcaacacagcagatatgtgcatgcagggactttgttttacaccggattacgtgatcatgacagcatacactgaggataaaaatgaaccgggagccctgatggtatttgaccgggaaaccggagattatcttgtgacacttggaatgaaaaaagacagtcaccttggtggtgttgcttttgacggagaaaatttatgggtatgtcactctaattccaatacactagagcgtatctcctatgaatatatcaggctgatcgcggaagatgcacctggttattgtattgatgcatctgcaatttcagacgaatattatctgagaaatacaccttcctgcattacctgttatggtggccgtatctgggtcgcaacttacaataagatgttccgctccaaaatgtatgcatacacctatgacacacagttagacaaattggttgcattgagtaattacaatattccatgcaaagtgcagggaattgcatttgattcacagggtgccgtatacttaagtacatcgcttggaagaagcaattcttcttacctgaaagtatattcttctctgattgcattgaaccagagcccgtcaacaccatcggttaaggtggagatgcctccgtgctccgaggaaatcgcaattgtggacaataacctttatgttttgtttgagtctgcaagctcaaagtattttgaaggtacagatggcaagggaaccagtgtagcaccaattgataaagtactaaaagtgaatgttgcaactatctggtaagaaattgccagatggaaacatgcatcataaagtgtatgagaaagaagcgggcggcctctattgagactgtccgcttctttctttcatgagccggatgattttatctgctttttctgcttcctccggtgacatgctctgttttaatatcgaaatcataagttctgtttcaggctttgtgaactggatattctgctttttggcagaggagagcgtgccgagcagaaatggcatcatgtctttcatttcggtaggttttttactgtttgcaaaattcattaaaaaagaaagcttttccggtgacagattctgaaataccggattggttttaaaaacatcattttccatagaaaatcctctctgattttttttacaacaaataaaggctgatggtgttatcctgcaaaaattgtttcataggtttcaagcatggaaaacatattggtcagcatatcgatcgtctcaagctcttttggggtacagaaagggcggaggctgtttaaaagtgactgtgggttgttttcctcttccggcagagagcacatggataagacctgctcttcctgtgaaaagatatgaagcgtattttgaagttccatatactttattaatatggcaaattgttttttttgtgaacttttcatgtatggaattacggtttttagcatctgaatctctctcgtctgcgtcatagtatcgaaaggggtaagtggtgtagcttcgtccataagaattgcctttttcttttattttatgtgcgaaaagaaacaatatgccagatatgtcgcaaacgaattttcaaagcataggatagagagaggaggaaaaatgtcatgttagtggtggaaaataacagtgtttatgagatagatgaagagtgtctcaaaagaagaagtgtgccagaggaatgtgaggtatacaagaagattgtcagagagcgggaagtggcaaagaacaaagagaaaacggaaaaaccaaagtaaacgacaaaaaaccacccagaccgtgaagtctgggtggtttaccggtcaggggaactttaggtcccccattgatgtctgcctgcgattagcagaagccgtttccgttaccacatccgccacagcagagaagaagtaagatgatccataagcagtcatttccaccgccacatccgttgttgccacagaatccgccgttattaccacagcagcagctcaataaaatgatgatccagagaatagagttgcatcctccctcattacatccacatccaccacagtttgttgcagctaaatcactcatgttaaatcctccaaatttttcttacactgtatcttatggaacagaggagaatgtgttacagtttttgaaaaataaattttttttgctattgagatataaaaatgggtttgctatagttaagttaatcataacaataaaagtataaaataatgatatagaatcacaacgtacacaggaggatgaggatggaatttgtaatgatcgtagagccggatgaggtggggagaaaaagacttgaggcagttttccagacagaaaagccttctttttcttatcagattacagggagaccggaggaggcactggatatattagaacatcagaaaacagatgttttagtatgtgagacgagtctttccgtactcagtggaagagaatttttcaccatggcaaaaatgatctcgccggatacggtccgtgtggcaatgacgagtgcagagcatgtaaaagacatcctctcttttctgaatgaatgtgatatctacaaattgatcatgaaaccgtgtgcgtcatttgctgattttatcgaaccggtgaatgcggcattggagtatcaccgcctgaaaaaacaggcagaatcagatcttgagcaggcaaatatgaatctctttttctcggagaaggattttgagagaattgaggagagacaaaaggagaatgtcatgctctataagcaggcagcagaggttgtcatgacgatgctgaagcagcatttgacgatagggcagatggattccgtgggagaatacatgatggaacattatctgagggatctgctcggatattatctggagacaatgatccatgaaaatggtaattatctgatggggtataaccggttaaaaaatgaatttcatcatgaggatgccggacaaagtttccatatgataaagaaagaagactgcgagatcccaccggagattttccggaagattcttttcctcctgatgatactcacaaaagcatgcaggcagattctgggtaaatatgctgtttcggttaccatggagacggcatctgaaaagttttttgtggtacgtttcagttgtgactattcgcagaatctcgataaaaatggacagatcatttacaccggagagaatcaggaatgtcacaaagatattatggatctgacagaaaaaattacggacagtatcgtatatcgtacggtttccctggaaaaagaaaacagatatatcttaaactgtgcgattgagcgcagaaatcatagagtggattcataacccaaaagcgaaccataactaattgttataataaatataagatattatgcattgacaaatagcagcaagagtgcctaaaataaagaaggtataattgtatacaattatgcatgtgaaaatagtcaaatattttgcatatatattcgtttactataaggaggatgttatgagagaagttgtaatgaatcaaaagacaaatctattgcagttagaagaacatttctaccagttagtggatgtggaagaaccaaatgtattccataatctgtttccttatgatgaaattccaaagattgcgtttaatgaccgtatcgtgccgcataatatgccggaaaatatctggatcacagatacgacattccgtgatggacagcagtcaagggctccttatacaacggaacagatcgtgaccatttacgattatttacataaattaggcggaccaaaaggtctgatccgccagagcgaatttttcttatacagtaaaaaagaccgcgatgccgtatacaaatgtctggaacgcggttataaatttccggaagttacaagctggatccgtgcgagcaaacaggatttccggttagtcaaagatatcggacttcgtgagacaggtattctggtaagctgttccgattatcatattttctataaaatgaaaatgacaaggcgtgaggttatgaacctctacttaagtgtaatccgtgaatgtttagagacaggcatcagtccaagatgtcatctcgaagacatcacaagatccgatatttatggatttgtgattccattctgtgtcgagctgatgaaactgatggatgaatataagataccgatcaagatccgtgcctgtgatacgatggggtatggtgtcaatttccctggcgctgtgattccgcggagcgtaccgggaatcatttatggcattaccacacatgcaggtgtcccatccgaattgatcgaatggcatggacacaatgacttttacaaggcggtcaacaactcgactacggcatggctttacggtgcaagcggtgtcaactgctctctgtttggtatcggagagagaaccggaaatacacctctggaagcaatggtatttgagtatgcacagttaaagggaaccttagacggcatggacacaactgtgatcacagagctggcagagtattttgaaaaagaattaggctatgtgcagccaagccgcacaccgtttgtcggaagaaactttaatgtcacaagagccggtatccatgcagacggtctgttgaaaaatgaggaaatttacaacatttttgatacgggaaaatttttaaacagaccaccacttgtatccgtatccaatacatccggtctggcaggaattgcattatggatcaattcttattatcatctgccaaaggaaaaaggcgtcgataagaattcagaacttgtcaagatggtaaaagtatgggtagacaagcagtatgaggaaggccgtgtgaccgttttgacagacaatgagttggtagaagagatcggtaagtgctgtaagaaattaaagatagatactttggagagataattatgggagaagacaattactccttgggttcgagagtctttcatatgataagggagaacattctttccggcaaatatgagagagatgaggaactgaaggagaaatcaatcggtgaggaactcggcgtcagcagaacccctgtgagggaggcactgcgtcagctggaactcgaaggtctggtcacgatcattcccaataaaggcgcttatgtggttggcatatcccagaaagatatcaaagatatttatgagatcagaagccgtctggaaggattgtgtgctaagtgggctgcggagaatatcacgaaagaacagttggatgagttggaggaaaatatttttttgtctgactttcatgcaacaaaaggaaacgcagaacagatggttgagctggacaataagttccacgagattttatataccgcaagtggcagtcgggaattacggcatgtgctttccgattttcatcactatgcccagcgcgtcagaaagatcactctttccgataagaacagggcagtggattcgaataatgaacaccgcaggattgtggaggcattaaaacagcatgatgcacaactggcagaaaagcttgcaaaccagcatattatgaagaccattgagaatatggatcactatggctgggataatttgttaaaaaagtaacatttgtgagattcatgaaaacaaggcagaaaggaaaaataagcgatggaaaaaattaaaatgacaaccccattagtagagatggacggagatgagatgaccagaattctctggaagatgatcaaagatgaattattaaccccttttatcgaccttaaaaccgattattatgatctgggattagagtatcgtaacgagacagacgatcaggttacaatcgattccgcaaatgcaacaaagaaatacggtgttgccgtaaaatgtgcaacgatcactccaaatgcagcacgtgtcaaagagtataatttaaaagaaatgtggaagagtccgaacggaacgatccgtgcaatcttagatggaacagttttccgtgcaccaatcgttgtaaaaggaattgaaccgtgtgtgaaaaactggaagaaaccgatcacaatcgcacgtcatgcttatggtgatgtttacaaagcatctgagatgaaaatcccgggacctggcaaatgtgagcttgtatacactgctgaggatggaacagagacgagagaactgatccataatttcacaggagcgggtgtggtacagggacagcacaatctgtgcaattccattgaaagttttgcaaaaagctgcttcaactatgctttggatacaaaacaggatctgtggtttgcaaccaaagacaccatttcaaaaaaatatgaccatacgttcaaagacatttttcaggaaatttttgatgcggaatacaaagaaaaatttgaagaggctggaatcacctatttctatacattgatcgatgatgcggttgcacgtgtcatgaaatcggagggcggctatatctgggcttgtaaaaactatgacggggatgtcatgagcgatatggtatcgagtgcatttggttcccttgcaatgatgacttccgtgcttgtctctccacagggatattatgagtatgaggctgcacatggaaccgtacagcgccattattacaaacatttaaagggtgaggagacatccacaaactctgtcgcaacgatttttgcatggacaggagccttgagaaaacgtggcgagatcgatggcatcaaagaattgcaggattttgcagataaattagaaaaagcttgtatatctaccattgagagtggtaaaatgacaaaagaccttgcgctcattacaacattagagcatccgactgtgttaaacagtgaggatttcatcaaggcaatccgaaccacattagaaggaatgttatcattatgattttatcttgtcagaatatctcaaagtcattcgggactgacgaaattttaaaaaatgtaagttttcatattgaagaaaatgaaaaagcagcggttgtcggcatcaatggtgccggcaaatctacgctgcttaaaataattatgaaacaggaaaatccggacgagggggaagtgacgctcgcaaaagataaaacgatcggttatcttgcccaatatcaggatgtttccggccaccatacgatctatgaggaagtattagattctaaacgcgacattatcgagatggaggaacggctgcgtgatatggaaacgcagatgaacacactctccggggaagcattagagcagcttttagatacttaccataaattaagccatgaatttgaacaggtgaacggatatgcataccgcagtgaagtgaccggtattttaaaggggcttggatttactgaggaggagttcgacaagaaaatgagcgaactctccggcggacagaaaacccgtgtatctcttggaaaactgcttgtgacaaagccggacatcctgcttttagacgagccgaccaaccatctggatatcgagtcaatccgatggctggaaacttttctgatgaattacaagggagctgttttaatcgtatcgcatgaccggtatttcttagaccgcgtcgtgagtaaagtggtggagatttttcagcacaagggttatgtttatcaggggaactattcggattatgcaaagaaaaaggcagcaatccgtgcagccatgatcaagcagtactataatcagcagcgtgagatcaggcatcaggaagaagtgatcgcaaaactgaaatcttttaaccgcgagaagtcaattaagcgggcagagagccgtgaaaaactgctggataagatcgaacgcattgagaagccgaccgaggataacacagatatccggattgtgttagagccgaatgtggtcagtggaaatgatgttttaaaagtggaagggcttgccaaggcattcccgccattacagcttttttcgggaattaatttcgaagtgaaacgcggggagcgtgtagcattaattggaaataacggaactggtaaaacaacgatccttaagattatcaacgagctgatctccccggatgcgggaacggtaacacttggaagcaatgtacatattggttactatgaccaggaacatcagcagcttcacatggagaaaaccatttttgatgagattgcggatgattatccaaatctgaataacacgaaagtgcgcaacgttctggcagcttttttatttacagatgatgatgtctataagcggattgaggatttgagcggtggtgagagaggacgtgttgcactggcaaaattaatgctttccgatgcgaattttctgatcctcgatgagccgaccaaccatctggacatcacctcaaaagaaattttagaggaagcactaaaaagttatactggaacagtatttttcgtatcgcatgaccgttattttattaatcagactgcaacacgtattctggaactgaccggagagacggttgtgaattatatcggcaactatgattattatctggaaaaacatgaccagatggttgcgttatatgtcaaaaagccggaggatgaggcacagacagaggcttctgtgaaagagactgcccagaaggtggactggcagacacagaaggcagaacaggcacggatccgcaagatagagaatgccctgaaaaaggcagaggaaaagattgcggagctggaagagaaaattgcttcgatcgatgcggaatgtgcaaagccggaagtggctgtgaactctgcaaagttaggagaactgacgaaacagcagagtgagtatcaggaagaattagaaaagcagtatgaagtgtgggaagaactttccatggagctggacgcgtaaaaatctggaaaatgtggtgatacggcagataaatttactctgttaaaagtttaacagattgacagatacagttgaaattactataataaaaatgatgcatcgcggcataagaagaaaagagccgtgaaagagagatacttcgggaggggcaaaaaatgcaggaaaaagaaatttcccaggcagtaatccgtcgtatgccgagatattaccggtatttaggtgaattgctggaggatggagtggaacgtatttcatccaatgatctaagcaaaagaatgaatgtcactgcttcgcagatccgtcaggatctgaataactttggcggtttcggacagcagggatatggatataatgtaaagtttttatatgaagagattggtaagattttaggattaaaccagaaacataatattattgtcatcggtgccggtaatttaggtcaggcactggcaaattatgtgaagtttgaaaaacttggttttgtgatcacagcactttttgatgtcaatccggcgttagagggtgtgacagtccgcggaattaagatccacatgttagatgaactggaagattactgcaaggatcacgttgttgatattgcagcccttaccatgccgaaggagaaggctgatgccattgcaaaccgtctggtcaatcttggaattcaggcaatctggaattttgcccatgtggaccttgatctgatcgacaaagatgtggttgttgagaatgtacatctttctgacagcctgatgcagttgtcctataatatcgtaaaaaataagcagaataaataatggatgaaatcgatagagctgccgcatgcattttttaatgcacgacagctctatcttatccatatgcctgaggggatgagaaggttatgaagtatctggtaaacagcagagagatgaaacaatatgatacgaacacgacagaacattttaaagtgccatccctgcttttgatggagcgggccgcacttgcagtttttgatgagatcaaaaggcagtacccatgcagcaaaaaatttctgatcgtttgcggaacgggaaacaatggcgcagatggttttgcactcacccggctgttacttttggacggagcagaggtgcatacggtgttgatcggtgaccggaagaaggagacagaccagtgcaaaaagcagctggagatcctttctgcctatggatgtccggtattggaagccattccggagaacaccgcatatgatgtaatagtggatgccatttttggagtcgggctttcgagaaatgttgaaggcatttttgctgatacaattcggaaaatgaacgaaataccaggaaaaaagatcgcacttgatatgccatccggaatttcatcggacacaggggctgttttaaaatgtgcgtttcgtgcagactgcacgatcacatttgcctatgaaaaaatcggcatgcatcttttcccgggaaatgaatatgtcggggagatcgtgacaaagcagattggaatcacggatgagagttttctgacacaaatgcccggtgttatggcgttcgagatggaagatctgagattccttccaaagagagcttcacattctaataagggaagcttcggtaaattactgctgatcgctggaagtgtggatatggctggcgcagctgttttaagtgcaaaggcagcgtatacggcaggctgtggtctggtgcgtgtgtttacgcctgaggaaaaccgcattccattgcagacaagtattccagaggcagttctgactacttatcaccctgaaaaattagatgcttcaaaactttcagaagcaatgaaatgggcagatgtgattgtgtgtggaccgggaatcggaaccggggatgcagcacatcagattgttaaaacagtgctgcaaaaagcatctgttccggtcgtccttgatgcagatgcattaaatatcattgcagaggacacaagtgttttacttttggcgcacacagaacttgtgatcacgccgcatcttggtgagatgagccgtctgaccggggattccattgcctttatccagacacggctgattgatactgcggataagtttgcaggaaaatttcatgtcacctgtgttctgaaagatgaacacacggtcgttgccactccacatggaaggacttatctgaacctctccggaaatcatggaatggcaacggcgggaagtggggatgtgctgaccggaatcataggatcacttctgacccagagggcagacacagagactgcggccgcgcttggtgtttaccttcacggactttccggagatactgcattgaaaaaatgtggttttcgtggtatgatggcaggcgacattgtaaatggtttgagagattttctggcagaaaatcaattataaaaaagattcattacgatagaaaggtatggatataacatgaataaacacagcagagtgtgtgcaaatatagatttgagtgcggtcatgcacaatatggaagccatgcatcagaacatcgatccggacacgaaaattatggcggtgatcaaagcagatgggtatggtcatggggctgttcctattgcaaaggagattgaacatttagattatgtttatgggtatgcagctgcaacggttgaggaagggatgatccttcgaaataatggaatccaaaaaccgattttgattcttggctatatcttcccggatcagtatgaggaagtaatccaggcagaaatctgtccaagtgtttttacacttgagatggcagaagagctttctgctgctgccgaaaaagttggaaaagactgccggatgcattttgcagtggataccggaatgagccgtatcgggtatcaggtgacagaagaagccgcagatgagatggcgcagattgcaaagcttccgcatatgatagtggaggggatttttactcattttgcaaaagcagatgagtatgataaaactttcacaaaagaacagattcaaaaattcagaaaaatgattgccatgatggaagacagaggtgtttcgattcccgtcaagcactgttccaacagcgcaggaatcgcagaaatccgcgaggcaaatatggatatggtaagagcgggaatcacgttgtatggattatggccatcggaagaagtcgaccagaattcccttgatttaaaaccggtgatggaattgaaaacacatgtggcttacgttaaggatttagaggctggaagagcgatcagttacggtggaactttcatcacaaagcgcgacagccgcatcgcaacgatcccggttggttatgcagatggatattgcaggggactttccaatacaggaagtgtcctgatccacggaaaacgtgcgccaatctgcggaagagtctgtatggatcagttcatggtagatgtgactgatattccggatgtgaagattggggatgaagtgacactgatcggcagggatggtgacgaagtgatcaccatggaagaagtcggcagcctttccggcagatttaattatgagtttgtctgcgtgcttggaaaacgtattccgcgtgttttttatcgggatggaaaaagaattgcaagccaggaatattttgacgaggaataggctggaaaaatatttttgaaaacagaatacgaccgttaaatatggaaatactatccgtaagaaacaacagtagagagaatactgagtaagattatggagtgtaaagcatatgttaattcggcgtggagatattttttatgcagatttaagaccagtggtcggttctgagcagggtggagtccgcccggttcttattatacagaatgatgttggaaacagacacagtcctacggtcatttgtgcagcaatcacttcccagatgaacaaggcaaaacttccaacccatgtggagttagactgcaccaagtatgcactggtgaaggattccgttgttttactggaacagttgcgcacaatcgacaagacgcggctgaaagataaagtatgtcatcttgacaatcagatactgatcaaaattgataaggcattggaaataagcttagagcttcttacataacttgactattctggagcaaaatggtattatttcaaatgttttaatacaatttcgatataaattaggaggatttatggacgatggtggcagtcccactaccgggatgaaaaagttgagtaacaggcttatgaagctgttcggagtagacaccgatgatgtgacagaagaagagattatctcaatggtaaatgaaggacatgagcagggtgtcctgcaggcgaatgaagcggagatgatccataatatttttgaatttggagacaaagatgcaaaggatattatggtgcaccgcaagaatatcattgccattgatggaacgatgacgttccttgaaatgctggatttcacgattgaaaataactattcgcgatatccagtatacatagatgatattgataatataatcggagtgcttcatattaaggaggtacttgcactgtgccagaaacaggagatttatcacacggcgatcaaagatattaagggattgatccgtgaggttgattttattccggaaacgagaaatattaataccttatttacgatgatgcagaatgctaagacgcatatggtcatcgtggtggatgagtatggacagacttccgggattgttgcaatggaagatatccttgaggagatcgtaggaaacatcgaggatgaacacgaccaggaagaaaagatgattgagaaactgccagatggcagttatctgatggatggtatgacttctgctgaggaggcacttgaaattttgaaaattcatattccggaggaagatgaatttgaaacgttaaatggtatactgatctctctgttagaccgtattccaaatgatgatgagaagtttgagacagatgctttcgggtatcatttcgaagttttacaggtggaaaataagatgatcaaaaaagtgaagatcacaaaacttgccgagggcgtttccacagataaggaagagaactcttgtcagaaagaagaaacggtgctagaataatatttctgagagattttgtaattgtgtgagaaacacacaaaacatataaaaagtttgacagacgaaaatacaagaaaaagagaggataaagttatgtcaggacattcaaagtttgccaatattaaacataagaaagaaaaaaatgatgctgcaaaaggtaaaatctttacgattatcggtagagaaatcgcagttgcagtaaaagagggtggcccggatccatccaataacttcaaacttgcacaggtgatcgcaaaggcaaagagcaacaatatgccaaacgatacgattgagcgtggtattaagaaagctgccggtgatggaaactccgtcaactacgaattctgtacatatgaaggatatggaccaagcggaacagctatcattgtaaaatgtttaacagataacaaaaaccgtactgctgcaaatgtcagaaatgcattcacaaaaggtcatggaagcatcggtacacagggttgtgtatcttacatgttcgatgaaaaaggacagatcatcatcgcaaaagaagactgtgagatggatgcagacgatcttatgatgatcgctttagatgcaggcgcagaagattttaatgaggaggaggactgctttgaagtattgacatctccagatgattttgaagctgtaagaagcgcattggaagctgagaacattccaatggcagaagcagaagtaaccatgattcctcagaactatgtagagttatctgcagacgaagatatcacaaacatcaaccgtatcttagatcttttggatgatgatgatgatgttcagcaggtttaccacaactgggatgaataaataatatgagacagactctgtttttggcgcaatccaagaacagagttttttcatatggacacttttttacaataaagtggtagaaatccgggggaaaatgttatatcataaatagtacaaggatgatgaggaggtataattcatgaagaggattctttttgcagcgtcagagtgcgttccgtttataaaaactgggggacttgcggacgtgtgtggtgcattacctaaggaattttcaaaagaggaatgggatgtcagggtcgtgattccaaattatagctgtattccggaaaaattcagaaaccagtttcagtatgtaacacatttttatatgtgtgcaggaaattatatccagaacaaatatgttggaattttaaaatatgaactggatggggttacctactattttattgataatcaggaatattttacctgtgatacaccatatggggatatccgttatgacattgagaagtttgttttcttcgataaagctgttttatccatgttaaaacagatcgatttccgtccggatctgatccactgtcacgactgggagacaggtctgatcccggtatatctgaaaaatgaatttcaggcagactctttttactgggggatgaaatcaatcattaccatacataatttgaagttccagggtgtatgggatgtgaagacgatgaaggggctgacaggattttcagcagatttgtttgcaccggataaactggaatttcataaggatgccaacatgttaaagggtggtttggtatatgcagattatattacaactgtaagcgattcttatgcacaggagatccagactgattactatggcgaggggctggatggactgcttgccgccagacactttgatatgcagggcattgtaaacggtattgattacaaaacatatgatccggagacagacccgaaaatttataccaactataacgcatcaaacttccgtaagaagaaggtcaataataaattaaaattacaggaggaactggatctgactgtcgataagaagaagttcatgatcggactgatctcaagactcaccgatcagaaaggtctggatctgatcaattatgtgattgaccgcctggtggatgatttcacacagattgttgtgattggaaccggcgatccacagtatgagaacatgttccgccattatgcatggaaatacggagacagagtttctgccaatatctgttattctgatgacctggctcacaaactttacgccgctgcggatgcatttttaatgccatcccgctttgaaccatgtggactgacgcagctgatctctttccgttacggtacggttccaatcgtccgtgagaccggaggacttaaggatacagtcagaccatataacgaatacgaaaataccggtgatggattctcttttgcaaattataatggggaagagatgctcggtgttgtcaattatgcaaagcatatttattttgataagaaaaaacagtggaatcagattgttgaacggggcatggcaaacgattattcatggaagtcttccaaaggaaaatacgaagggctttataattatctgcttggatatactgtataaaataaaaagaatctccaatactaaagaacagggtagaaaaatctatcctgttttttcagtcttatgagggaagggagattgtatggcagaaaaaaatgagaaagagaaggctgtgaatgagcagatcagggattttggtcaggtggagttagagcatggggaagacaggatctccatgttgacgatcataggagagattgaggggcatgagtgccttccggcggcgacaaagacgacaaagtatgagcatgtgcttccaaaactcgcagaggtggaagaaaataaaaatgtggatggattactgcttttgttaaacacggtaggcggggatgtggagagcgggcttgccattgctgagatggtagcatccattgataagccaacggtttcactggtactcggtggcagccattccatcggcgtgccgctggcagtctccacggactattcttttatcgtgccatccggtacgatggtgatccacccggtgcggatgaatggaactgtgatcggggcgcagccaacgtatgattattttaagcagatgcaggatcgtattttaaaatttgttgtgcagcattccaaagcagaacagaaccggctggaggagcttatgatgaatacgggaatcctcacaaaagaccttgggacgatcctggttggaggacaggcggtcgaggaaggactcattgattctatcggtggaatccatgaggcatttgcaaaattacaccagctcatacaagagacaaaatccggcggcaaaaaaagcttttaatgacaatcaaaatgaaatatggtatacttaaaaagtatgaaaatcggtgacttgtggaaaaaactgatattttttagaaaatatgagatacgatacagcggaggaaaaagcttatgactttattacaggcggtcttgatggggatcatacagggattgacagagttccttccggtcagcagttccggacatcttgcactttttaaaatcctgttccatgttgagacggatacaggaatgttatttgatgttttgctgcatgttggaactctgatcgcgatctgcgcagtttattataaagatatcgtcaggctttttgtggagggaatctgtatcgtgagagatgtgctgatcaattttgcagcacttataaaaaacctttttctatcgatccgtgacagaggaaaagatcatgttgattacagtccgtaccgcagaattgtaaacagcagttaccgcaagtttgtggtgctgatcctggtatcaaccattccgaccggaatcattggttttgttggaaaagacgtggtagagcaggcatcagaacttctgatcgtgccgggcatctgtctgatcgcaaccgcaattctgctctttatcgcagaccgctgcaagggcggagacaagcttccgaaggacattacatacaccaatgcgtttgtcgttggtattgctcagggcgtggcaactttgccgggactatcccgcagcggaacaacgatcacagcatgtctgctcagcggatttaaccgcaagtttgcagtgaaatattcgtttattatgtcgataccggcgattttaggtgccatggtgttagagttaaaagattttgcagacctgtctgtgagcggcatggatattacctgctatattgttggtatggtgattgctgcagtgatcggatatatctgtattaaaacaatgcttgtcattgtgcgcaatcggaaattccgtatttttgcaatttattgtctgattgtcggactgctctcaatcggcggatttttctatacattataggagatattttttggaggtaatattttggcaacagggaaaagaaagagttcctctggcagaaaaacttctggcagaaaaacgaattcaggacgtaagaagaatgatatacagcaggagagctttacagaggaagtgattctgtgggtgatccttgcaatctccattttactttttatcagtaattttggaatcggcggggcaattggaaatgctgtcagcagtttcttttttggtgtatttggtttgatcgcatatatttttccggttgttttggtgatcggtactttttttgcggcgtccaataaaggcaatcggatcgcaacggtaaaaattgctgcggctgtcttttttgtgctgtttttgtgtatgtttatcgagatcgtgcgctgtggcgcggaagttgccggagcggcaggtgcctatcagtattgttcggtacataaaattggcggaggatttttaggtggtcttcttgccgggattttttgtccaaattttggactcctcggttcttatgtgatcgatgttgtggcaatgattatctgtctggtgctgatcacagaacgttccgcattgaagggtgtgcagaaaggcagccgtaaagtttatgaaacggcaaaagagagcaatgaacgtcatcgtgaacttgtagaacagcgacgtgaggaacgtgagctgcgccgcatggaccgcaaggtggaaggcgtggcagtcgacacaagagttcttccggacaggaaggcagagcctatgggttcggatgaagtcagtgaaattaatattgacaaacttttggagcagtcgaacaccaatctgccggaaatcaaggcggagaagcatgtgacactcacagccggaggcgcagaatatcaaaaacttcctgctatggaaccggagacggaaccgtatgttgctccgtccgcattttctaaggaagcgtttgaggcaaaagagctggaagaggatgcatcaatctttcactcagagccggcatatcaggagagtatccatacagagccggcttatgaagaacatcatccagtagaagaatctattccgtatgatgccgcagaaaaaccggaagagccgcatgtgagagcagaaaaagtagagcttcattcatcagaaagaaccgaaaaaccgaagaaaaatgttaaggctacggaggaagatattcaaaatgatgtctcatccatcgaggaagagattcatctggaggcacagaaggaaagaaagtatgtgttcccaccagtatcattgttaaaaccgccaggcaataagcagggagattccaaacagcatcttcaggagacggcacagaaattacagcagacattaaagaatttcggcgttaacgttacgatcacgaatatcagttgtggaccatcggtcacacgttatgagatccagccggaaatgggtgttaaagtaagtaaaatcgtgaatctggcagatgatatcaaactgaatctcgcagctgctgacatccgaatcgaggcaccaatcccgggaaaggcggcagttggaatcgaggttccaaataaagagacactgatggtttctttccgtgaacttgtggattcgccggaatttaaaaatcatccatccaacatttctttctgcgtcggaaaagatattggaggaaatgtaacggttgcagatattgcaaaaatgcctcatttactgattgccggtgcaacaggttccggtaaatctgtctgtatcaacacgattattatgagtattttatacaaagcagatccgaaagatgtaaaactgatcatggtcgatccaaaggtggtcgaacttagtatttataacggaattccacacttactgattccggttgtgacagatccgaaaaaagcggcaggtgcgcttcactgggcagtcgcagagatgactgaccgttatcagaagtttgcagaggcaaatgtccgtgacttaaaaggctataatgccaaaatcgatgatctgccggatggggaggacaagccggaaaaattaccacagatcgtgatcattgtagacgagctggcagatttaatgatggttgcggcgagcgatgtggaggaatctatctgtcgtctggcacagcttgcaagagcctgtggaatccatctgatcatcgcaacacagcgtccgtccgtcaatgtcattaccggactgatcaaggcgaatatgccaagccggatcgcctttgcggtgacatccggaattgattcgagaaccatccttgatatgaacggtgcagaaaaactgctcggaaaaggtgacatgttatttgatccacagggagtaccgaaaccactgcgtgttcagggcgcatttgtatcggataaagaagtagcggatgtcgtcgcttacataaaagaagaaaacgggcaggtaagctacaattcatctgtggaagagcagatgaacagcattgaatcaggaaatacgactgtaagcattgattccggacagacaggggacggcagagatccttattttgcagatgcagcaaaacttctgatcgataaagaaaagggttcgatcggaatgctgcagcggtattttaaggtcggctttaaccgcgcagcaaggattatggatcagttggaggaagccggaattgtcggaccggaggaaggtacaaaaccaagaaaagtactgatgtcgccggaacaatttgagcagtatgaagaagaatatctgtaattgatatttgcttatcaataagacttgtattataatatcaacttataagtcctgtgtaggacaaatacaatatgcgaaagagaatcgcaggaatggagttttggaatgaaaagtgatattcagattgcacaggaagcagaaatgctcccaatcaaagaagtagcagaaaagcttggaatcggagaggatgacctcgaattatacggaaaatacaaagctaaattatccgatgaactgatcgagcgggtaaaaaatcagccggatggaaagctgattcttgtgacagcaatcaatccaactccggctggagagggaaaaacaacgacaagtgtcggacttggacaggcatttggccgtttggggaaaaaggcagtgatcgcattgcgtgaaccatctttaggaccatgttttggtatcaagggaggcgccgcaggaggcggttatgcccaggtcgttccgatggaagacttaaatcttcattttacaggagatttccatgcgattacttctgcaaataatctgctggctgctttgcttgataaccatattcagcagggaaatgaacttggcattgatacaagacagattgtatggaaacgctgtcttgatatgaacgatcgtgtgctccgtaatactgtcgttggacttggaagcaaaatggatggtgttgtgagagaagatcactttgtcattaccgttgcctccgagattatggcaattctctgccttgcaactgatatgcacgatttaaaaagaagattaggacgcattattgttgcctatacttatgatggaaagccagtgacagcagatgatcttcaggcaaccggagcaatggctgcattattaaaagatgcgttgaaaccaaacctcatccagaccttagagcacacaccggcaattgtacatggtggtccgtttgccaacattgcacatggatgcaactctgtccgtgctacaaagacagcattaaaacttgcagattatgtgatcacagaggcaggatttggtgcagacctcggcgcagagaagttctttgatatcaagtgcagaaaggcagatctgaaaccggatgcagtggttttagttgcaacaatccgcgctttgaaatataatggaggagttgcgaaagctgatcttgcagaggaaaacttggaagctttgaaaaagggcattgtaaatctggagaaacatatcgaaaatcttcagaaatacggagtaccggtggttgttactttaaactcctttgtgacagataccaaggcagagacagactatgtagagcagttctgccatgagagagactgcgagttcgcactttccgaagtctgggaaaaaggtggcgaaggtggtattgcacttgcaaacaaagtgcttgagaccttagagaaaaaagaaagccatttcaaggtattatatgagaatgatctttctctggaagaaaagattgagactatcgcaaaagagatttacggtgcagacggcgtgacttacgcaccggcagcaaagaaagaattaaagagaattacagatatggggctttccaatttccctgtctgcatggcaaaaacacagtattctctttccgatgaccagacaaaacttggccgtccggagggatttaccattaacgtaagagaagtatatgtatcagcaggagcaggctttgtggttgctgtaacaggtgcgatcatgacaatgcctggtctgccaaaaaaacctgctgcatatggaattgacgtaaatgacgaaggtgtgatcaccggtttattctaaaaaagaaatgcagtagaaagaacagagtgagaggaattatggcacagattattgacggaaagaaaatttcacaggacatcaaagatgaattgaaagagaaagtgacagcattaaaagatacaggaacggaggttgcacttgcagtgatccaggtcggaaatgacccggcatcctctgtttatgtaagaaacaaaaagaaggcctgcgagtatattggtatccggtccttatcctatgaactcccggaggagacaaccgaagatgcattgatcgagctgattgaaaaactgaacaaagatgaaactgtaaacggtattttagttcagcttccggttccaaagcatattgatccggataaaatcatccgcacaatctcgccggaaaaagacgtagacggctttcatccacagaatgttggaaaattagtgatcggtgaagagggctttgtatcttgtactccggccggagtcattcagcttctgaaacgttctggaattgaaatttccggaaaaaactgtgttgtagttggcagaagcaatattgtcggaaagccaatggcgcttctgatgcttcgtgagaatgctacggtcacgatcgcccattcaaaaacaaaaaatctgaaagaattatgccagacagcagatattttgatcgttgccattggaaaaccacaatttattacagcagattatgtgaaagagggagctgttgtgattgatgttggaatccacagagatgaaaataataaactctgcggagatgtacgatatgaggaagttgcagaaaaagcttctgcgattacaccggttccgggtggagtaggtccaatgacaattgccatgcttatgagcaattgcgtggaaagtctggacagagaataagattggtagagatagaaagggtttcatatgaaatgtgcaaagtgtggagctgagttaaaagaaggctgtttatattgttcggtatgcggccatgaagcacaaatggtaaatggttattctgttttggaggaagattatctgaaagctcttttgacagatgaagcatccaaagatacatcgtcagaagaaacagaaaaccagaagaaaaaagcagagggacaccataaaaagaaaaaacagactccgtggattgttttaggctgcgttgctgcagtggttgtcgtcattgcaatcggagcaattgcttacgtgcgctatcagaataacaattcgtacgattaccagattgagatggcagaaaaggaactggtggatttaaactatgagaaggcgctttcttactataaaaatgcgctgacattatcaccaaatgacatcaatgccagggctgcaatggcggaaatctatcttgcaagaaaagaatatgattctgcattagtgcttgagatggagatcatcaacctcgataaaaagaacaaagaggcttatcagggattgatcacgatttatgaggcaaaaggtcagtacgataaaattacagagctggcgtctactgtgacagatacagatttattagaactgttttccgggtatattgtcgctgaaccggtcttttatccggatgagggaacatatgatgtgtatacggaagttaccattttttccattgaagaatgtgatatctattatacattagatgaatcagatccgaaaaaaaatggtattctttataccgatgccggaattgaattagacgatgttggaaagtatactatcaaggcagtctgcaaaaacgataagggaatttacagtgatgttgtcacctgtaaatataagaccgaagcgaaagccccggattatccggaagtaacaccggatggcggtaccatggatgatattacgtttgtagtaataactgcggatgagggatgcagtatttattacacgtgggatggaacagatccaacagatacatctgcacgttacacagaaccgatcgaagtaccggaaggtaacaatatcttatccattattgttgtgaatgataagacaaaacttacaagtgagatctaccggacaaattttatctatcatgcccagcctggagttgagatagaagagtagcggaacgttgtaacttttattatgtacgaagtgaataaagaaaatgccattgaatttaaaactcaatggcattttttatgtaataggaaacttcgtttccattacataaaaaagctccgcaaggatcgcactgcggcggataagaagtatgtcgcatattgcgacccgccgcaggcggagaatctcgcaagcgagattcatttttataaatgaaacataatcaatgatagatttaacattcctccggaatgaactcgatcacacccttggcaagcttggaaacacgagctaatgagtatacatccacaccctgtgcaattaatttgtcacgtcccggctggaaagatttctcgatcagaataccaatacctgcaatggaagcaccggcctcggtcagtaagcggatggcaccgcttgcggcttctccgtttgcaaggaagtcatcaatgatcagaacgttatcattttcttcgatgaactgatgggataatgtcagttcatagcttgtgccttttgtgaaggaagtcacaacggtctgaagcagattatcatttaaaaccttagaaggctgtttctttaaaatgatcattggaacgttcaaagagatagccgtcattagtgccggagcaatcccggagctttcgatggtaacaactttggtaatccccttgtttccgaaatgtcctgcaaatgcatcgccaatctgctgcattaaaacaggatctacctgatgattgataaagctatctactttgagaatattctcagataaagcatgaccttcttttaagattttttcttcaagttctttcactatgtcacctcataaatatgtattgttatatttttagaacgataaaatatagattccggatctttctgttcgttctttattttgcatattgtagcacaattacagtgtgaaaaaaagactatttcgtgttttcttcgaataaattcccgtaaagttcttccaccagatgatccagaaaggtttcctctaaatccgggtactgttttgagaggaaacgggtcatgatctcatagcgtttaaagtaaagatcctgatcaaaaacttcctcgtccatgctctcatcaatatcttttgcgctgtaagtggaagtaaaccaggaaatgatttcagaagataaatcattttctttttctgcctgcgtgccaagtgttttcaactgccgcaacgacacaatgccgatcacgaagaagatgaggagcatgacacccataacgatacagagcataatcttcatataatcagcgacatggacaggaagtactccggtggcaaataaaataagtgcaataaaaccgaaaacactcaccaacaggaatgaataggcagtggatttcgtctcttctttttttgattcctttgaaacataaactttcataatgattctcactttcgttttttactttgttataattatatttgatttactagaccggggcaacggttatatgatataatttttctgtatgaaaataacaattttatgtgtgggaaaaattaaagaaaaattttacagggatgcggtcgctgaatatgaaaaacgtctgagccgctattgcagatttgaagtgactgaggtggcggatgagaagacaccggatcatgcaagcgagaatatggagcttctcatcaaggagaaagaagcggagcgcatggagaagtatctgaaggaaggtgcctatgtgatcgcccttgcaattgagggaaaacagttagattctgtggaactgtcgcagaaaattgattctctgggaacatccggtacaagccatattatttttgtgattggcggttcgctgggacttgcggaacgcattttaaaacgggcagactataagctcagtttctcaaagatgacgtttccgcatcagcttatgcgtgttatcttatcagaacagatttaccgcagctaccgcattatcaatcatgagccatatcataagtagacgataaaaacagacaattttaaaaataacaaacatagtgggaggaattgtattttatgttacgaatcagagagtatcgcaaggtggaaagtttagaggaagcctacgaactcaatcagaagaaaacgaaccgtatcataggcggcggactctggatgaaaataggagatcggaatcttatgactgccatagatttaagtggtcttggattagatcagatcagtgagacagaggatgagtttgtgatcggctgcatggcaacactccgcgatttagaagtgcatccgggactgaatgcatacacagatggcgcggtaaaacagagtgtctgtcatattgtcggagtgcagttccgcaactgtgcaacctttggtggaagtatttatggaagatttggtttttcagatgtactgactttatttgcggcactggattgctatgtggaattatataagggtggaaatgttccaattcaggaatttatccatatgaattatgataatgatattcttgtggcagtacatattgtaaaaacacctgtgaagatcacttatctttcacagagaaacacagcaacggattttccggtaattgcagttgctgtttcagaatataacgaaaaactgcatgtcagcattggtgcaagaccggtaagggcagagacactgacacttgacctttcagaaaaagcagatatggaacatctggtaaaaaaagtgcaggaacagttttcgtttggaagcaaccggcgcggcagtgcagattacagacgccatattgcaggagttcttgtaaagagagcctgtgcggcaaatgaacagcaggaggatagaaaatgaagatacatttatggctgaacggcaaagaaatctctgatgacatctcaccggatatgcctttattggaatatgtcagaacaaagggatgttacagcgtaaaacgtggctgtgagacatctaactgtggactttgtaccgtgtggatgaacaaaaaacctgttctttcctgttcggtactcgcagcaagggcagatggaaaagagattgtaactttagagggtgtgcaggaacgcgcggcagaatttggaacttatcttgcaaaccagggcggtgagcagtgtggcttctgtaatccgggatttatcatgaacgttctggcgatggaggatgaactgaacaatccgaccgaggaggagatcaaggcatatctttccggaaatctctgccgctgcagcggctatgagagccagctgcgtgcaatcaaaaattacctgaaccgtaaccgggatatagagtagaattagataattgcgaaactcatgagaacgtaaattgaattgtgaaaaattaacaaaagcttgagaaaacactggggagcggtcggttcttagaaggcaggtgcgatgtcaatcgtgactggcttcttagtaccgttactagcgacacgtagcgagagcgtgttttcgaaaattttgttaattttgaacaattaaaagaggcacctgaggagtttcgcaattatctgatagagtagaataaatgcaaggagaaacgatatgaaatatgtaaatgctcccgtgatgaaaaaagatgccatggcgcttgtgacgggaaaaccagtgtatatggacgatgtggcaccgaaagactgtctgatcgtaaaagtactcagaagtcctcatgcacatgccctgatcgaagagatcaatatcaccaatgcattaaaacaaaaaggaattgaatgcattttaacttataaagatgttccacaccgtcgatttacgatggcaggacagacctttccggaaccgagtccttacgaccgttatatcttagaccagcgtgtccgttttgtcggagatgcggttgcgattgtcgccggggaggacgaggcggcagttgaccgtgcattaaagcttatcaaagtgaagtatcaggtgttagaaccggtgcttgactatcatacagcgaaagataacccggttcttgtccatccggaggaggactggaaggcactctgtccggttggtgcagacaatagacggaacctttgtgcgtcaggcatggacagtgacggagatgtggatggtgtcatgaaagactgtgacattgtcatggaaggaacctatcatgtaaaggcaatgcagcagagtatgatggaaaccttccgcacagcgacttatctggatacttatggaagaatcaacattttatcttctacacagatcccatttcatgtgagaagaatccttgcgaatgccctggacattccaaaatcaaaagtccgcgtcataaagcctagaatcggaggaggttttggagcaaaacagaccgtggtagccgaggtatatccggcaattgtgacgatgaaaaccggaaaacctgccaaaatcatttataccagggaagaatccctaattgcatcgtctccgcggcatgagatggaagtgaccgtgaaactgggcgcaatgaaagatggtatgatccgcgcattagacttgtatactctgtcgaatacaggtgctttcggagagcatggaccgacaactgtaggtctgagtggtcacaaatccatcccgatgtatcagacggaggcatttcgttttcagtatgatgttgtatacacgaatcatatgtcagcaggcgcttaccgcggttatggggcaacacagggaatttttgcagtggaatccatggtaaaccggctggcagacaaacttggcatggatccattggaaatccgttataaaaacatgacacatgaaggtgatgtcatgccggcttattacggagagaccgcaaatagttgcaagcttgaagactgtctgagaaaagcggcggatatgatcggatgggagaaaaaaccgctgcgtcaggttatgccggatggaaagatccgtggacttggaacggcaatggcaatgcagggttctgcaatttcaaactgtgatgtcggctctgtcacgatcaaactgagtgatgagggattttacaatgtgatcgtcggatgtactgatatgggaaccggctgtgacacgatcattgcacagtttgttgcagacagtctggatacggacattgacaacattgcagtatttggagtagatactgatacctcaccttacgattccggttcctacgcttcgagtaccacgtatctgaccggtatggctgcagtgaaagcggcagaacagatgcgtgaaaaactgctgcagcttgcggcaaaaattctggaggaagatatcacaaaactggagtttgacggcaaacgtgtattttgtgaagaaaccggaaaagaagtatcgctgtttgatcttgcaactgcatccatggtcaacaatgagattgcattggaagttacctacagtcacagttccccggtttcgccgccaccgtttatggctgcctgtgcagaagtggaagtcgatccggaaaccggagccatcgaacttttggattacacggcatgtgtggactgtggaacggttgtgaatacgaatcttgcaagagtacagacagagggcggcttactgcagggaatcggtatgacactgtatgaggatgtctggtacaacgagaagggtgtgaatctctcaaactcccttatgcagtacaagattccgacccgtcttgactttgataaaatccgcgtggaatttgagagcagttacgagccgaccggacctttcggtgcaaaatcaatcggtgagattgtaatcaacacgccggctcctgcaatcgcacaggcagtatacaatgcaacgggtgtatgggtgaatgaattgccaatcaccccggagaagattttaaaagggatgcatgtgatttgagatggaatctgattctgctggcagccggatattccagacgttttggagacagaaagctgttggcagagataaatggaacacagctttatcgcttttcactggataaaataagaaagctctcggaaaaacttggagatacgaccattcttgtcgtgacatcttacccggagattgaagcatattgcagaaaacagggctttaccgtgataaaaaatgacggaacagataataccggaattgcatcctctattcaaaaagcggtgaaatatctggagacacaggagtgtgccgtggagggcagtcgaaaggcagatgttttctttacagcagaccagcctggacttgacgaaaatgaggtatggatgtttttgaaccaatatgcatcgcagaacaaaaaaatcggtacgatggaatgtaaaaatatctggcgcagtccaaacgtatttgatgcatgctatcgtccggaattattacagctttcggcggacaaaggcggaaaagctgtgatgaaacagcacgcagaggatgtgttttgttttcacacagaaaaagaaacacagtttttggatattgatacgagagaggatttattgcgcatatcagataagcttttttcataagcttatatatgagtaaaaacagtaaaaaaccaatccatgaaaaaatgataagtcagttagaactccccaaagaccttatgcttggagcggcaattgtcacaattaccgggcggaaagaggttctggtcgagaattataaaggaatcattgaactggaggattcacttgtgaaaattcagacaaagaactgcagacttcagattttaggagctcatctgacggtggagtattacacgaatgaggaaatgaaaattgtcggtctgatcgactccgtttcttacgagtattaatgtttgtcttatcatggatcaaattttttcgtggatatgtgtatgtgcatcttaccggatatgccacagagcgtttcctgaatttatgtggcagccgcaacattttaatctggaatttaaaaccaacggaagatgggtactatttttatatcagcgtggatggttaccgcagtttaaagccaatcttaaaaaaaacaaagacaaaggcgcgcattttaaaaaaatacggtgtgccgtttcaactgttccgctaccggaaacataaagtatttgcggcaggaatcgccgtttccgctgttttgctcttttactgttccggttttgtctggaatattgaagtaaaaggcaattcttatctgtcagaggagacaatcctcacgtttttacagaacgaaaatgcaggcttcggtgtgccaaaaagaaatatcaactgcgaagaactggaagaaaaactgcgttctgcatacagtgaagtcatctggacttcggtaaaagtctacggcacgaaaatgacggtggaacttcaggaaaatctgctgccggaggaggaatacgaggcaaaggatgacacgccggaagatatcgttgcaaaaaaagacggtgtcattgctttcatggtgacgaggacaggaacaccgcttgtgaccgcagatatggaagtgaaaaagggagatatccttgtcagcggcagggcagaaatcttgaatgacgacggtgaagtggcggaatatatttatccgggagcggacgcagatattattgcagaagtaaatttttattatgaggatgaaataaatatttcgtatcaggataaaataaaaacaggcagggcaaaaaaagattatgggatcaggttctttgattatcacctgaaaaatccatttttccggcaggactatgagcagtttgatctgacggagcatgccagccagctgcattttaccgacaatttttatcttccggtttattttgaaacctatttgtatgaagaatgtcagacagaggaaaaaacgtatagtaaaacagaggcagcagcaattgcacagagccgttttgagcaatatcttgcaaatttagaggaaaaaggtattcaaattctggaaaaaaatgttatgatagaaaaagcagatcagaaatatgtggtaacagggacggtggatgcctatgaatccatcgtttcatatcagccgacagagattctggaaataacgagtgaagagaggcagcaaccgaatgagtctgactgaaatatctttaaatataccaaccgaacatgtggcaaatgtctttggacagtttgatgcctatataaagaaaattgagcgcactcttaatgtgacggtagtcgttcgtggagattccatgaaactgattggaaatgaacgtcagatcaagagtgcttctaatgtgtttatgcagcttttggagttgtccaaaaggggaaatgtcatcacggagcagaatgtgaattatgcattgtctttagcggcggaggcgaaagaatctgcgatcgtcgagatcgataaggactgtatctgtcatacaatcaacggaaaaccggtcaagccaaagacgcttggacagaagaattatgtggatgccatccgccagaagatgattgtcttcggaatgggaccggcaggtaccggtaaaacataccttgcaatggcaatggcgatcacagcgttcaaaaatgaggaggtcggaaggatcattctgaccagaccagcgatcgaggcaggcgagaaacttggatttctgccgggagacttacagagcaaggtcgatccgtatctgcgcccgttatatgatgcgctttatcagatcatgggagctgagagtttccagaagaatatggaaaaaggattgatcgaggttgcccctcttgcctacatgagaggccggattttagataatgcatttattattttagacgaggcacagaacacaacacctgcccagatgaagatgtttttaacccgcatcggatttggttctaaagcagtcatcacaggtgatgcaacgcagaaagatctctcacccggaacaacttcaggtctggatgttgcactgaaagtgttaaaaaaggtagatgagattggtatctgtgaactgaccagccaggacgttgtgcgccacccggtcgtacagaaaattgtaaaagcatacgaagattatgaaaatcgcaataaaaagaaaccggcagagcagaagaaaaagtgggagaaacgatagatgaaggaacagtttgtggcaaagaggatcgtgaatataggattgatttttcttgttgcaattgggttttctgtcattgccggcaggatgggcgggatgtatttagaccagcttcttggaattggagcattgacggttctgtttatggttttgtttgcgtttcttttgatttatgagagaaaccggaaaagaatatcgcataatcgcgagacggattatggtaagatttttaagggatttttgctgactgcaattcttgcagtgatctttcttttcctgccagagtttacaagtccggtcatgatcctgccaatcttaatgtcggcggtcggaacgtatgagcttgctgtgtgcagttcctttttcttttgtaccgtattggagatggcaaagggctgtcagtcctatgagatcctgtgctgcacgatgttgcttctgtttggattcgtgattgcacatatgttggaggataccaaaaataaagtgtggtatctgattcttatatttgcagtggctgttttggctccggtgcttttttcgtactttttttatcaggaaccgcactatgatattctgggcaaagccgcaattggggctgctgtgacggatcttgcagctgcgtttgtttatccgtttctcacaaagcagaaagaggctgagattgataatttcttaacagatatcacagaagaggattacggtcttttgcgtgaactgaagaagttttcgaggcaggaatacagacatgcccttcgtgtgtcgggaatcgccgaaaaatgtgcagatattgtaggggcagatgctgctgtctgtaaagcggctggtctttattatcgtattgggattttagatggcgatcctatggtggaaaacggggttgcaagagcgcagaatcattgctttccggaaaaagtgacggaaatcctctctgagtattatggaatcgaaaagatgccgtccaccattgaatctgcgatcgtacagattgtagacgggatgatcaagaagttagaagcacttgagaagacaagcaaaatcgccggtggctggaacaaggaaatggtgatctatcagaccttgaatgagttctctgcccagggactttacgaccagtctggacttagtatgaatatgtttttaaaaatcagagaatatctggtaaaagaggaggctttactgttatgacattgaactttgaagcggaagtaaacgtaccatttgattttgatgtggaagctttagcaggggaagtgatcaactttactttggaacacgaagatttcccatatgaacctgaggtaaatctcacattagtagacaatgaggggatccatgccattaacaaagaatttcgtgagattgaccgtcctacggatgttttatcatttccaatgctttcctatgaaaatgcaggagatttttcaaaactggaagatgattatgatgataattttaacccggataccggagaaattatgcttggagatattgtaatctcggtggacaaggttttagaacaggcagagagttacgggcataccacaaaaagagagtatgcatttctgatcgtacatagcatgttacacctgtttggctatgaccacatgacactggaggaagctgccgtgatggaagcaaaacaaaaacagattcttgatgagatgaacatcacaagataaagaaattttgaggaataatatgagtaataaaaagagtagcaccagttttttagtgcagggttccattcttgcaatggcatcgatcatcagcaggatcatcggtcttgtataccgtatcccgctgactgctatcatcggaaataaaggaaatgactattatggctgtgcctttgagatttataatatattgctgatcatttcttcctacagtctgccgcttgcagtatcaaagcttgtgtccgcagatatgtcgcttgggagaaagaagaatgtataccgtattttgaaatgtgctctgatcttcggtctggtgtccggtacgatcgccgcattgatcctattctttggagctgagtttatcacaggaacgatcatgaagacgccttacagtatttttgcagtgaaggtgcttgtgccaacactgatcgtagttgcagtactcggcgttatgagaggattttttcagggactcggaacgatgatgccaagcgcagtctcgcagatcttagagcagatcgcaaatgcgatcgtgagtgtgtgggcagcctatgtgctttataactacggaaccaaagtgggtgcggtgcttggaaatgcagaaaactatgccgctgcctacggtgctgcaggaggaacgcttggtacgggaaccggggctgtggtaggacttctgttcgcagcctttgttctgctcgcatatttaagtgtgtttaagcgtcagatgaagcgggaacgccgggcaaaggttgacagctattcgtatatttttaaaattttatttatcaccatcataccggttctgatgagtactacaatctacaattgtaatgcaattttagaccaggcaatttttaaaaacattgcaaacttacagggatactctgcaaatgatatcagtgagtggaatggtatttataccggtaaatataagacattgatcaatgtgccaatctcgattgcatctgccctggcagcatcttccgtgcctgcgttgaccgcggcttacacaaatggtaagaaagaggcagtccgctcacagatcaacacagcaatccgttttatcatggtggttgcgttcccttgtgcagtgggaatgggtgttcttgcatctccgatcttacagcttttgttccgtgattcctcggaacttgcagcgagtatgttgcagcttggtgctgtttctattgtatttttctcgctgtcgacgctctcaaatggtttgttacagggaattaaccgtatgcgggaacctgtaaaaaatgcattgatcgcgctggtgcttcatatcggattactcgttgtactcatgtatgtctttaaattaaatatttacgcagttgtttacgcaaatgcattttttggtttgttaatgtgtgtattaaatgcacactccgtgaaaaaatacagcggctaccggcaggagatcagacgtacctttgtgataccgggcatttctgcgctcattatgggtgttgcagtttatctgtcgtatcagcttgcattatatctccttcgtgtgaatgcgattgcaaccgtattcagtattttgatcggtgtgatcgtctatgcagtggttcttttgctgctgaaaggtctgactgaagaggagattttaaaatttccgaaaggtgctgcacttgtaaggcttgcaagaaaaatgcatctgctgcgataaattgcaaaaacaaatttacaggcatggaaatttttcgtttaaaaatgtaaaaaatggcaaatacttatcaggggtgatgaaattgaaaaaaatgataagtgtttgccttttatttgtattgcttttggctggttctttatggatagaccagacaatgctttcttctgagaaaccaaagccggaagaggtggcacaagaaatggttactgatacggaaaaaatgacagagagcatgtcacatctctcttatacaaaatattatgtccatgcttcagaaggctatgtggtcatctgtcaggcggatcatgagacggtttactgtgagacttctatccgggtggaacatctcccggaggaacttcaaagcggcctaaaagagggaattgcactttgttcggatgaggaattatatgaatttcttgagaattattcatcataatttcttgcgaattattcgccgtaatgatttgattgttacttttacttatggtaatataaaaaaggttttcaataactttaaaccatgtgaggaaaaatcgttaaagttttgcaattgcctagagaaatacaatgtgaggaatcatgaatataaatgagaaaaaaagctttgatgtcatagtgatcggcggtggagctgcaggaatgatggcggccatcacggctgcgtccaatggggcggacacgatgatcttagagcataaagaccgtgtggggaagaagattttatccaccggaaacggaaaatgtaattatacgaacgaattgcagggtgtcacgttttatcgcggagatgaccctgcatttgtgctaccggttatggaacagtttggttttgacgagacggtttctttttttgaaaaacttggtatttatccaaaaagcaggaatggttactattatccggcgagcgagcaggcggcatctgtattagatgtgctccggatggaattgacattccgccatgtctctgtggtaaccgagtgtgagcttcgcaatattttagagaaaaaaaacggttttctgttagagactgacaaaggaagattttctggaaaaaaaatcatttttgccacgggattattggctgcaccaaaaacgggaagtgatggaagcgcaattcctctgatcaaggcatttggacatcgtttttcggatgttgttccggcattagttgccttgcagtgcagagaatcctttttcaaacagcttgcaggaatccgcacagaggcagaagtgtcacttttcatagatggagagagcatcgcctcagagcgcggtgaacttcagttgacggattatggaatttccggaattccgatatttcaggtcagccgttttgccacaaaagcgttaaagagaaagcagacggtcacagcacagattgattttctgccaaagctgagtgaacaggagatagaacaattgttcgaaagtcgctttcgagaatatgcgcatggcaagactgcggacgaggcaatggtcgggctgctgaaccataaattgagcgatgtgctgttaaaggaagcgcacatttcgctgaaaaagccggcagaggagatcacgaaaaaggaattgctgcagcttgtaaaacagtgtaagcacatggaagtctgtgtgacaggaagcaagtcttttgaacaggctcaggtctgtgcaggcggggtacatacagatgagatcaatccccggacgatggagtcaaaacttgttccaaacgtttattttgcgggggaagtggttgacattgacggtatgtgcggcggctacaatttacagtgggcatggtcgagcggctatgtggcaggcatacattcggcaggatcatacagaacacatttctgtgtcaggtgcacggaaaaatgaccggggaatgaaattacaaaaatgcaggaaaatcaggaaaaaagaatgatacgagttagtcagttaaaactgcccgtagaacatagtgaggagcagttctatcagaaaattgaaaaaagtttaaaaataaaaagagatcagatcaaaaagttacagattgtaaaaaaatcaattgatgcaaggaagaagccggatgtctccattgtctactctgcagatgtatgggttgacaatgaagagaagattttaaaacactccggaaacaaaaatgcagtctgcgtcaaagagaaaaaatataaagtaccggaacatggcacagagtgtatgaatcaccgaccggtggtgatcggggcaggccctgcaggacttttctgtgcgtatctgcttgcaagggaaggatacagacctctcgtattagaacgtggaaaaaaggtcggagagcggacagaagatgttttacacttctggaaaacaggcgtactgaatccggcatccaacgtgcagtttggtgagggcggtgcaggaacgttttcagacggaaaattgaatactctggtgaaagatcctcttgggcgcaaccggttcgtattagatacgtttgtctcctttggagcaccggagaaaatcacctatgagaacaagccgcatattggaacggatattttatcgaaagtgattgcggcaatgcgcgaagagatccttcatctgggtggcacattcgagtttgagagctgtgtaacagatattcgggtggaaaaccagaaaatcaaagccgttgagatcaatcacaatacctggatggaaacggaagtctgtgtgctagcacttgggcatagcgcgcgcgatacgtttgagatgcttcataagaccgggctttttatggagccaaaggcctttgcagtcggtttccgtgtggagcacccacagagggacatcaaccgcagccagtatggggaaaaatacgcagaactgcttgaggcagcaccttataaagtgaccgcaaaccttgcaaatggaagaggcgtttactccttttgtatgtgtccgggcggctacgtcgtgaatgcctcctcggaggaaaaacgtcttgcagtcaacggaatgagttattccgaccgtggaagcaagaatgcaaacagcgcgatcatcgtctctgtgacaccggacgattttgacggaacggacgcactttccggtgtagaattccagcgcagactcgaagaaaaagcgtttgcacttggaaacgggaaaatcccgcagcagctttttggcgattactgtgaaaataaaaaaagtacagcatatggaaccttttcttcggagacaagaggcgaaactgcttttgcaaatttaagaggcctgttttcagatgagatggagcagtcttttatcgagggaatgcattcctttgcaaaacatattccggaatttgaccggaacgatgcgatcctgtccggcgtggagagccggacatcctcaccggtacgaatccgcagggatgaggcgtttgaggcaaatatcagaggcatttatccatgcggagagggagccggatatgccggagggatcacttctgcggcaatggacggcatgaaggtggcagaggcggtcattcgaaaatatcagcctttcaaataagggaatcgcagtcagaagaatcagataattgcgcatgataaacaggcgcaatggaaggaagtaacataagtggcagaatttacaccaatgatgcagcattatctgcagaccaaagaagaatataaagattgtattttattttaccgtctcggtgatttttatgagatgttttttgatgatgccgtgttagtgtcaaaagagttagagctgacattaaccggaaaaagctgcggtatggaggaacgtgcgccgatgtgcggtatcccatatcatgcggtggaaggatatttaaaccgtctggtagccaatggacataaagtggcgatctgtgagcaggtggaagatccaaagcttgcaaaaggaattgtaaaaagagaggtcatccgtgttgtaacgcctggaacgaatatggatatccaggctctggatgaatcaaaaaacaattacattatgtgcattgtctatctggcagataaatatgggatttcccttgcggatgtttccaccggcgactattatgtcacggaagtggactccgagcggaagctgatcgatgagatcaataaattcgcaccttccgagattgtctgcaatgagagcttttatatgagtggcgtggatctggaagacatgcgtcatcgtctcggaattaccatttattctctggatgcatggtacttcagcgatgagacggcggagacaaccttaaaaggacattttcatgtcaacagtctggaggggcttggcttaaacgattatgcatatggaacgatcgcagcaggggcattgttaaaatatctctatgagacacagaaaaacaatctggatcatatttctgccatccatccatattctaccggcaaatttatgatcattgacagttccacaagacgaaatctggaactggtagagacaatgcgtgaaaaacagaaacgtggttcgctgctctgggtattggacaagaccaaaactgccatgggtgcaagactgctgcgttcttatgtcgaacagccgttgattgataaggcagagatagaaaaaagacaggatgcgatcgcagacatcaacaaacatatgatcaccagagaggaactgcgtgagtacttaaacccaatctacgatcttgagcgtctcatcacccgtgtgacttatatgtctgcaaatccgagggatctgatcgcatttaaaaattcaatcggaatgcttccgccgatcaaaacattactggaagattttgatacggaacttttaaaagaacttcagacagatatggatccgttagaagaactttatcagttaattgatgcatcgatcatggaagaacctccgatttctgtgcgcgagggaggtcttatcaaagacggttataacgaaaatgtagacaagtaccgtcacgcaaagaccgaaggaaaaacatggcttgcagagttagaggcaaaagagcgtgaaaagaccggtattaaaaacctcaaaattaagtttaacaaagtattcggatattatctagaagtgacaaattcctaccgggatcttgtgccggattactttacgagaaagcagacactcgccaatgcagagcgttatatcacaccggagttaaaagagcttgaggatatgattttaggagcagaggacaagctgatcaatttggaatacgatctgttctgtgaagtgcgcaacaggatcgcagcggaagtggtccgcatccagaaaacagcaaaagcggtcgcaaagcttgatgcctttgtttctcttgccgtggtggcagaccagaataattactgccgcccgaaaattaacgaaaatggtgtgatcgacatcaaagacggcagacatccggttgttgaaaagatgatgaacaacgatatgtttatcgcaaatgatacatatttagacaacggcaacaaccgcatttccatcatcacgggaccgaacatggcaggtaagtccacttacatgcgtcagacagcgatcatagtgctgatggcacagattggaagctttgttccggcatcttctgcaaaaatcggaattgttgaccgtatttttacaagggttggagcgtcagatgatcttgcaagcggacagagtacgtttatggtagagatgaatgaagttgcaaacatcctgcgcaacgccaccagtaactcgctgctcgtcttagatgagatcgggcggggcacaagcacatttgatggcctgagtatcgcatgggcggtagttgagcacatcagcaatccgaagctgctcggagccaagacactgtttgcaacacattaccacgaactgaccgagttagagggcaaactgcacaatgtgaacaattactgtattgcagtcaaagaaaagggcgacgatatcgtgttcttgcgcaagatcgtccggggcggtgccgacaagagttatggtatccaggtggcaaaactggcaggtgtgccggattccgtcattgagcgtgcaaaacagatcgtggaagaattaagtgcaaatgacattaccgcagtcacaaagaatctgtccgtcgagaccggaacaaaaaagaaaaaagaaaaattagacgaagtggatcttgcacagatgtctttatttgacacggtaaaagatgatgatattttagaggaattgaagaatgtcgatctgagcaatatgacgccgatcgatgctttgaataaattatacgaattgcagaataagatcaaaaaccgctggtaaagagcagttttttgatggaaagaaagggagtgtctgaaaatgccggaaatcatgttactgaatcaggagacaatcgataaaatcgcagcgggcgaagtggtagagcgtccttcttctgttgtaaaggaattagttgaaaatgcgattgacgcgaaagcgactgcagtgaccgtcgaaatcaaagaaggcggtatctcttttatccgtattacagacaatgggtgcggcatcgagaagaagcaggttccgattgcttttctgcgtcattctaccagtaaaatccgcagtgtggaagatctgctcagtattcattcccttggcttccgcggtgaggcactttcaagtatagcagcagttgcgcaggtcgagctgatcacaaagacctatgaggaactgacaggaaccagatatgtgatcgaaggttccaaagaagttgaaaacgaggagatcggggcgccggaaggaacgacttttatcgtaagaaaccttttttacaatgttccagccagaagaaaattcctaaagaccgcccagacagaggctggatatatcagtgacctgatggagcgcatggcattgtcccacccggatgtctcctttaaatttattaacaatggtcagacaaaactacacacatcaggaaatggaaatgaaaaagacctcatttaccatatttatggaagagatattacggccgcggttctgaaagtagaacatgagaccgaactgtttaagcttcgtggttttattggaaaaccaataatttccagaggaaaccgtaactatgagaattattttatcaacggccgctacatcaaaagtgcactgatcgccaaatccattgaggaggcatacaaaggttttatgatgcagcaccagtatccgttctgtgtgctttactttgagatgaactcggaacttttagatgtcaatgtacatccgactaagatggaattgcggttcagtcagaatgaggaaatttatcgttctttatttgagattatccgaaatacaatctctcatcgggattttatcccggaagttccggtgacagaagaaaagaaagaaatgattccaccagttccaaaacatacaccggagcctttcgagatcaggcggcgcggtcaggatgctttttttgaaaaaatgaaacagaccagtgccagtccattgactgtgcaggaagaaaacttatttgcaaagccgcttgcagcagaagcggaaacaaatacttccaaagagccaatagcagaaatacattctgaacaacctacattagaaaataattttaaagaaatcgtatcagaaatacatgacatagaatctacaccgcaggaaaccgctccaatctatgatcagcagaatttagaacagcttgactctcattttctgacgaaagatgcaagaaaaaaacataaaatcatcggtcagttattcgatacctactggctgattgaatacgaggataaactctttatcatcgaccagcatgccgcacatgaaaaagtactttacgagcgcacgatgaaaaagatttcagagaaaacatttacatcgcagacaatcagtccgccaatcatcctgacattgaatcaggatgaggtgcaggcactggaaacttatgaagcgcagctctcgatgtttggatatgaaattgaaccttttggtgggaaagaatatgcaattactgcaattccggcagattttacagatatcgacatgaaaaccatgtttattgaaatgctggatgattttgccaatatttccggcaaagacgcaccgaatctgattatggaaaaagtggcgtctatgtcctgtaaagctgcagtcaaaggaaacaatcatctttccagaccggagattgaagcgctcattgatgagcttttagagttggataatccatacaattgtcctcatggaagaccaacgatcatttccatgacaaaatatgaaatcgaaaagaaattcaggagaatcgtataaaaattatgacagaaaaaagaccgatggtcattttgaccggaccgacagccgttggaaaaacagccttgtccatcgagcttgcaaaaaaaatcaacggatcgatcatctccgcagactccatgcaggtataccggcatatggatatcggctctgcaaaggtgatgccggaggagatggatggcgtcagacactatctgatcgatgaatttgaaccggatgaagaattccatgtggtaaaatttgtggagcgtgcgaaagagcatttggaggaaatctatgcagagggaaaaatcccgatcattgcaggcggcacaggattttatattcaggcacttctctatgatattgactttacagagcaggagtgtgatgaggcataccgggcagaattagaacagcttgcggcagaaaaaggtgcacactatctgcacaacatgctgcgtgaagtcgatccggcgtccgcagatgccattcatgccaataatatcaagcgcgtgatccgtgcattggaattttatcatctttccggcagacggatttcagaacacaacgaaaaagagagggagaaaacatccccttatcattttgcatattttgtgctcacggatgagagatcacatctttatgcgaatattgacaaacgggtcgatcttatgatagaacagggacttgtggatgaggtgcagaaattaaaaaatatgggctttcaccgtgatatggtttccatgcagggacttggctacaaggaaatcttagattatctggatggaaaaaccactttagaagaagccatctacatcatcaagcgtgagaccagacattttgccaaacgacaactcacctggttccgccgtgagcgtgacgtcatctggcttgataaacaggcctatgactatcaggatgcaaaaattttagaggatatgataactattttaaaagaaaagactatcataaattagcaattataattttgagcaacttataacagcaaaaaaaagagtttcgctcaataacgaagagaggataaatagatagcaatgaaccagtttttagaagaacaatacaaaaatcttggaatctcgagggaagtatacgaatttggagaaaaaatcgaggaatctttaaaggagcgttttgcagagatcgatgcaagagcagaatacaaccagatgaaagtcataaaagcgatgcaggagaaccgcgtcagcgcagaatgttttaatatgagttcgggatatggatataatgatcttggaagggatacgctggaaaaagtgtacgcttcctgttttaagggagaggatgcactggtcagaccacagattacctgtggaacccacgcgcttgcactcgctttaatgtcgaacttaagaccgggggatgagcttatgtctccggttggaaaaccatacgacaccttagaggaagtgatcggaatccgtccatccaagggctctctggcagaatatggtgtcacttaccgacaggttgatttattgccggacggaagttttgattatgagaatattaaaaaagcgatcaatgaccgcacgaaactggtgacaatccaacgttccaaaggatatgccacaagacctacgttatccgtaacaagaatcggtgagctgatctcctttatcaaaaatatcaaaccggatgtaatctgcatggtagataactgctacggcgaatttgtggaagaaaaagagccgttagaggtcggcgcggatatgatcgttggttccctcatcaaaaatccgggcggcggacttgcaccgatcggcggctatatcgtcggcaaaaaagagtgcgtggaaaatgcagcatatcgtttgacttctccgggacttggaaaagaagttggagcatctctcggtgtgatccagtctttttatcagggatttttcatggcaccgactgtggtgagcggtgcgttaaaaggagctgtttttgctgctaatatatatgaaaaattaggtttttccgtcattccaaacggtacagagagccgccacgatatcattcaggcagttaccttcaacaacccggatgcgatgattgcattctgtgagggaatccaggcagctgcaccggtagacagttatgtaacaccggagccttgggcaatgccgggatatgacagtgatgtcatcatggctgccggagcttttgtgcagggatcttccattgaactcagtgcagatggacctatcaagcctccatacgccgtttattttcagggtggcctgacctggtatcatgcaaagcttggaattttgatgtctttacaaaaacttaaggaacggaatcttgttaatacagatttgttatgctaaaatgaaaaaagagttttttgagttgacataaaacactttcagggagagtgaaaggaatttatgaatcactcattcacaacaaaagaattaccggaatccgaaagaccatatgagaagttctggaaatacggtgcaacagcgttaagcgatgcagaacttttagcgatcgtgatcaaatcaggaagcagtaaaatgactgccgtggatgtggcaagaagttttttatcacagaaagacagaaacctcatgaatctttatgagatgtcttacgatgaaatgaaaaagatccacggaatcggagatgtgatcgcgatgcagttaaaatgcattgcggaactttccacgcggattgccaataccagacattttgagggtattcagatgaggagcgcagcaacggttgcagagtattatatggaacagctaaggcacgagcagcaggagaagctgatcgtctgcatgtttgacagcaaatgtaaatggctgggagactctgttgtcacaacaggaagtgtcagttcctcgattgttccgccgagagagatttttatctgtgcattggagaaaaaggcagtacacattgtgatggtacacaatcatccaagcggcagggcagttccctccggagaggataatacagtgactgcaaggatcgcagaagccggaaaattattaggcattgcgctgtcagatcatattattataggtgaccgtacttacttcagttaccgggaagccgggtatctcacataatgggaagttaccgttatgaaatactccgtgaaactacaacggattctttgattatggaaaacaacacaagggagaagaaaatgaacagcaacgtatatggaattgatcttggaacctgcaatatgaagatttactgcaagacttccaataaaatattaaatgagaagaataccatagctctggtaaaaaaagaccagatttatgcttatggtgatgctgcttatgcaatgtatgaaaaagcaccggagacgatcaatgtcacattcccggtgatcagtggagtaatcgctgattttaataatcttcagaccatgctccagatgtacttagaagagcatatgaagggaaaaatccggggcgctgaatttatcgttgcggttccaactgatattacagatgtagaaaagagagcgttctttgagatgttctacaagagtaaattaaaaccaaagagtgtccttttatgtgaaaaaccaattgcggatgccgttggccttggactggatgtcaatgagccgaccggtatcatggttgtggacatcggtgcagatacaacagaaatttctgtcatctccctcggcggactggtattgagtgatctgttgcatttcggaggcaaccggattgatgaatcgatcattacttatgtgaagagaacctataatcttgtgattggtcagaagaccgcacaggcattaaaagagaagcttggttccggtattcctggaaatacagaaaccatggtcattgtaggacgtgatgtggtaagtggacttccgattgagatggagatcacaggggaggttgtctacgaggcgatcaaggataacttaaacagcatctgtaattccatcaagatgatcttagagaaaactccaccggagcttgcaaaagatattatccattccggtatttacattaccggtggaagctcccagatacataatctgagccagttgttcaaagatatcaccggcattgagatcaacacctgtgaggagccggaagagtgcgttgtccgtggactggtgaagattgtaagtgaccagaagtacaaacatctggcgttcagcatgaaaaataaaatcttaaaatagaatgtaatgcaggatacgcctgcatacgttgttagaaattgaggaatggaatgagacgaaaatcaaaattttttcttcctgcaagataccttcttctgatcatgtcaggggtatgtattatcatcatgttattaagttttactttaaatatatccggtggtccgttaaatgcggcagccggttatgtttttgtgccaatgcaggcgggaatcaataaagttggcacctggatctccgacaaggcggtaaatctgaaaaacttaagtgatgtcatggcagagaatgaggatctgcagaatcaggtagatgaactgacaacagaactgaatacaattaaactggagcagtacgagttagacaacttaagggaactttacaatctcgatcagaaatacccgagttatgagaaagttgcagcgaatgtaatcggaaaaaacagtggaaactggtttaatacttttacaatcgataagggtagtaatgatggaattgaagtggatatgaatgttatggcaggaagcggacttgttggaattgtcacagatgtcggaccaaattatgccaaggtgacatcgatcatcaacgataccagcaaagtcagcggaatggttacgaccacttcggataacctgatcgtgtccggaagtctgcagaaaatgaatgaagatatggtgatcgaattcaataatttaaatgacaaagacaatgaagtttccatcaatgatccggtggtcacttccgcggtttcttacaattatcagcagggaatcttaattggatatatcagctcgatcgagacagattccaataatctgacaaaatcaggaaccattacaccggcggttgattttgagcatatcgaagaagtacttgtcattttgaacaagaaacagacggtggaaaattaaatcagggaggatgacatgcgaagaaaaataactgtatttttaatcatagcagtttgttaccttttgcagagtaccgtatttcaggcactttcttttgcatcaatctctccaaatctgatgattgttgttgtctctgcatttggttttatgagaggaaaaaaagaaggactgtggattggctttttcacaggacttcttttagatgtttttacaggaagtattctgggattctacgcattgctttatatgtatgtgggctatttcaacggatttttccggaaaatgttttacccggaagatatcaaactgccgatgcttctgatcgcagtcagcgatttttcatgcagtctgatcatttatttcctgttatttttattccgtggaaagtttgatattttatactatctgttaaatatcatgataccggaacttgtatatacaatggttgtgaccattttcttatattttataattttaaaaattaaccagaaacttgaaacaatagaaaaaaggagcgctgtaaaatttgtttgataatatcaaagagtttttccgtacgatcttcagatcgaggctgcttgtcgcagcaaccgtgatggttcttttattttctgtgctgattttccggatgttccagctgcagatcataaagggtgaagaatatcaggacaattacacgttaaagattgtccgggaacgtacgttaaacagtaccagaggaaatattttagaccggaatggcgaagtgctcgcatacaatgaactcgcatattccataacgatcgaggataatggttcctatgattctaccaaagaaaaaaataaacttttaaatgcagaaattgctgatatcattactgccctggaaaaaaatggggatgacattatcaataattttaaaattacagtgaacgataatggaaattacgaatttacggtgagcggaagttcattgaaacgttttcttgcagatgttttcggtcaggcatcttattctgatctgaagtatgacaaaaaacttggttacaatcaggcggaagcgactgctgaccaggttatggattatctgaaagtgacacgttttggaatcagtgaagattatgccgaagatatggcatataaaatcactgtggtgcgctatgcaatgtctgaaaacagctatcagaaatatattgccaccacgatcgcaagcgatgtctctgaggagtctgttgcctacgtgagtgagaatacatcaaagcttcagggtgtggaagtcattgacgatacgatccgcaaatacaatgatgctgaatattttgcatcgattatcggctacactggaaaaatttctaccgaagagtacgagagtttatctgcggataacgacaactatactttaaacgacgtggtcggaaaagccggtattgaacaggtgatggatgcgtccctgcagggaacaaaaggctatgaaaagctttatgtcgattatcttggaaaagcggtggaggttttggaacgtgaggagccttctgccggaaatgatgtatatctgtcgatcgataagaacttacagattgctgcatatgatctgttagagcaggagatcgcaggtattgtatattccaatattgaaagttccggttctgagatgaatatcccgatcactgacgtttatttcgcactggtaaataataatgtaatcgatattgaacatttttcagatgaaaaagcaaccgaaaatgaaaaagctgtcatgcatattttctccggcagacagcagaccgtcctctcgtctgtgaccagcgagttgaagggggcatccccggcagcatttggttcactcggagaggaagatcaggattattttacttatattatcaaccagttgaaggagaaaaaaatccttctgcagaaatcaattgataaaacggatgaggtatatcaggagtggcagagtggtacgatcagtgcccaggaatacctaaaccatgcgatcgcgcagaactggattgacatcacacagtttacaattgatgagaagtactcggattcgacagaaatctacgatgctttgtgcgattatattatggatgacattgccacagataccggattttccaaaattatttatgagtatctcattaaggcaggatctgtttccgggaaacagttgtgtctgatcttatacgatcagggagtacttgcctacgatgcagaggagatcagttccctggaatcgaatgcagtcagtccggtcagctttttaaaggataagatcaagaatattgagatcacaccggcacagcttgcattggatccatgctccggttcctgtgtgatcacggatgtaaaaaccggagaactgctggcattggtaagttatccgggatatgataacaaccgtcttgcaaatacggttgatgcagattattttgcaagtctcaacacggatttgtccaagccactttataactatgcaacgcaggaacgcaccgcaccaggatctactttcaaaatggtatcctcggttgcaggtcttgccacaggtgtgattacactgacgacacagatcatggacaagggtgtgtatgaaaatatcagcaaccatccgcgatgctgggcattaaatcacggttacacgcatggactgatcaatgtatctgaggcactccgtgattcctgtaactacttcttttatgatgttggttatcgtcttgcaacgaataatttttctacatcctacgatgatgcgactggtatttccaaaattcaggaatacgcatcgcttcttggattagatgagacaacgggtgtggagattgaggaaaacgatccgcagattgcagatgaatacccggtcatggcagcgattggacagagtaataataactatgcgaccatccagcttggaagatatgtatctgccattgcaaatgatggaaatgtatatgaatacacattgttgagcaaagtatgtgattccgatggcaatacattggaaacctttgagccaaaagtaagaaatacggtggacgtattagataccacacaatggaatgccattcataccggaatgcgcatggtagtggaaaatctgtctacatttgataatttctcaattgaggttgcaggtaagaccggtaccgcacagcagagtccaaaccgtccgaaccatgctttattcgtcggatatgcgccgtacaatgatcctgagatatcgatcgcaactcgtatcgcattcggttatacatcacataatgctgccgaatatgccaagaatgtattttcttactattttggtgttcaggatgcagaagaactgctgaacggtcaggcagaaaatgtaggtgagtcatcaaacagctttaatgactaagtaaaaggaggtcttacttcatgagtgaagtgatcactttcacgtcaggaaaaggcggcgttggcaaaacaactaccacagcgaacgtcggagttggactttcactattagagaaaaaagtaattttgatcgacacggacatcgggcttcgcaatctcgatgttgtgatgggacttgaaaaccggattgtatataatctggtcgatgtcctcacaggaaaatgcagagtgaaacaggctgtcataagagaccgcagatatccgaacctctcagtcattccatctgcatgtgtgcgggagcatccgccaatcacgacagaggcgatgcagacgctcatggaggagttaaaggagtcgtatgattatatccttgtggatagcccggcaggaattgacagcggctttgaccttgccgtctgcgcggcagataaagcagtcgttgtgacaacgccacaggtggcggccgtccatgatgcagactgtgtcttgcgcctgctccgaaggaaaaaagatatctccacttatctgctgatcaattcatttcggaaacagttggtaaaagagggaaacatgcttcagatttccgatatctgcgaacttttgaacacggaacttctgggtgtggtactggaagatgaacatattatcatttcccagaatcacggtgagagcatgatgggaaagaaaggcacttcccagacatgttatgagaacatctgcagacgccttgtgggggaagcggttccaatcccggattttcttcaggaaaaacaccgtttccgcggattcttctggaacaagcctgcaaagcagaccatcaattcatagctgacttttgtgcatagcagaaatggagaaaaaatgagagaacaatctgtaactgccgcaaaagaacgtttaaaatgtatgatccattatgaaaacaacattttagacgaagaaacgatgggatacatacggcgcgatatcggaaatgtgatcacaaagtatgtagatgtagaacctgagaatattgagataaaagtcattttaaaagaatacaaaaagagagaattgcaatgtttaaacagtacaaactgagaaattataagttcatattggtcatgtatgtggtgatcttaaatgtgatcggaatccttctgatcggaagtgccaagccatccgtgcagagcaaacagattttgggtatgatcgccgggcttacgatcatggtgatgctctccctgatcgactataactttattttgaagttttcctggctgatctacttttttatggtcggtgtgcttttgctcgttatgtttgccggtgatgatgccggtggtgcacagcgctggtttgagatcggaggattccgtttccagccttccgaattggcaaaaattttaattatattatttttcgcctacttttttatgaaacatgaagaaaaaattaatacaccgaaagtactgatctcgtcatttatactcgcgggaataccgcttgcgctcattttaaaacagccggatctttcaacgacgattgttaccgcattaatttttgctgccctcttgtttgttgcgggattaagttataaaatagtaacaggtgttttggctgtcagtattccatcagcagtgatactgtttacgttgctgatccaggacaaacttccgtttatcaaaagttatcaggtgacacgtgttatggcatggctttacccggatgattacccggcagatgcttaccagcagcagaattccatcatggcgatcggttccggccagctgtggggaaaagggctgaataatacagatgccacttcggtaaaaaacggtaactttatcccggaaccccagacagattttatctttgcggtagcgggggaagaacttggatttatcggtacggttatcattataattttattgcttttcatcacgattgagtgtatattaattgctagaaaagcaaaagataccgcaggaaaaatgatctgctgtggatttgctgcactggtgggctttcagagcctggttaacattggggttgcaagtggggtgcttccgaataccggtttgccgcttccatttgtcagctatggtcttacgtcgcttttatcattatatataggggtggggcttgtgttgaatgttggactacagccgaaaaaatattgacaggaggtaaccgcataatgaacattggacttattgcgcatgattcaaaaaagaaattaatgcagaacttctgcattgcatatagagggattctttcgaagaatgaactttatgcaaccggaacaaccggaagactgatcgaggaggtgaccaatctcaatgttcataagtatctggctggacatctgggaggttcccagcagctcggtgcacagattgaacataatgagatcgatcttgtcattttcttaagagatccacttactccgaaatctcatgaaccggatgtaaataatgttgtgaaattatgtgatacacataatattcctttggcaacgaaccttgccactgccgaacttttgattcgagcattagacagaggagatttagagtggcgtgaaatgtataaataaaatgagactgctgtgtctgtgtggcatagcagctgtttttatgtccgggtgcggacagacggtagtaagttatgataatccttatgatatctacagcacttcggcagattatggattggcatctgagggagccgggtcagaaaaaacttatttttcacagaatctgtgtgtggcagatgatgtgaacattggaaatgatacgactgattcgcaggtggcagaaggagcaggaaccttcaatcttgcgactaataccgtaacttacgcacagaatatttatgaaaaattatatcctgccagtacaacaaagattctgaccgcatatatcgccttaaaatacggaaatctggaagattatgtgaccgtcagtgaaaatgctgcaaatcaggcttccgattcttctgtctgtggtttaaaagcaggtgatgtggtgcagcttaaggatctcttatatggcatgatgttgaagagtggaaacgatgctgcaattgcgattgcagagcatatcggcggaagtgtggaaggttttgcagatatgatgaatcaggaggcacttgcaatgggtgctacaagatcccattttgtcaatccaaacggacttccggatgaaaatcactatacctccgtttatgatctctaccttattttccagaatgcagtgcagaatcagacgtttctcgatatcatcagtacgatgagttatgatgttgtatacacagatgtgaatggtgcgggcgtagagaaaacatgggagaatacaaatcagtacctcaccggtaaggaaaaagcgccggaggggatcactgtcgtaggtggaaagaccggaacaacaggagctgccggatactgtctggtattatattcttacaatgcttccgggcagccgattgtctccattgttttaaaagcagacggaaagtcaaacctttatcttctcatgaatgaaatgctcagtggttttgcgaattaacagttgtattttatgtgcatatgtactataattgttttataaaacctactgtttttattcaaaatacataaaatagggaatataaggaggaaatgacaatgatagaaattattgcaggcgaaaagggaaagggtaagaccaaagaattattagccaaagtaaatcattctgttacagccgcatccggaaatattgtttatctggacaaaagccagaagcatatgtatgaactgaacaacaaggttcggctcatcaacgtgatggattatccaatcgataattgtgatgagttccttggattcttatgcggaattgtttcacaggatcacgatctcgaagagatgtatcttgatagtttccttacaattgcatttaccgagacggatgacgagatccagcatgcaattgaaaaacttgacatcatcagtgagaaatacaatgtgaagtttatcttaagtgtttcgagagatgagtccagattacctgagtgtgcaaaagcaaagattgtcatttccctataattactttgctgttaaaaggttgctgcgctaacttgttttagtgcagcaaccttttttgcatacagataaacccagttttttctaagcttcgtccccactcttaattcttccataaagactgatcgtgtaaagtccaccgatacctaccagcgcatagacaatgcgggaaagccatgaaagatttccaaacagaaatgcaacaaggtcaaagcggaagaatccgatcagtccccagttaatggcaccaatgatcaccaatgtcagtaaagtataatccaaccaatttgttttcatgagtatatctcctttgatatcatctttttgtttattttttcctgtgaaaccgttttttatacatgaatcgcattgttttgccctgtaaaaaatgctataatgagcggaagtgagaaaaacaaggcaggttatgcaattgaagaaaaacaaaaatgttgtgaaatatagaaaaccaatgaattttaatattggtgtcattatatttgtcatcatctttatttatctggtatttaatgtgttcagttatctgacagagacacatatttctgtttatgaggtggagcagggaaccattgcggtcaataatgtatacaatggtctgatcctgcgcgatgaaaaaatcatcaattcagattattccggtgcagtgaattattatgtaaaagagggttccaaagtagcctacggcgatttggtctgctccgttgatgagaatggagacgtttcgaacatgatcaacgaggccagccaggatggaagtaccatcgacagtgagaaccttgcagaaattgagaaaaccatcaatgactttttatatgcctatgatggaaaaaactattatcaggtatacagctttaaggacaatgtcaatgcatctctgagtgaggcattgagtgtaaacgccttaaatgatatctcggattatgttgcttctgcggagaacaataatacatttcataaagtgatcacagatgtgccaggaatcgtaacttattatacggacggatttgaaaatgttacggttgataattttacggccgcaatgtttgacgaatccaattattccaaaaacgatttgaaaacaaacccggctatccaggccggttcacctgagtacaagctgatcgacagcgaatattggaatattattgttccagtgccggatgcaacagcggaatcattaaaagatgacgatacaattaagatccgctttttaaaagatgcaaaagaagcctacgcgacttattccattgtcgagcgtgatggacagcagtatttgattctctcactgaaaagtgctatggtcagatatgcgtcagagcgctatgtggagattgaacttttactgtccgaagaaaccggtcttaaaattccaaattccgcgatcaccgagaaagagttttacaccgttccaatcgattttttcttaaaaggcggggattccagcgatgagggaattctggtggaacgcacggacaaggacggaaaaagtaccacggaatttgtgacaccaaccatttattatgagacagacgatacctattatatcgacagtgagtatgtgtcctccggggatatcctgcagaaaccggattccagtgagacgtatcgtgttggtacagacactgcatcgttacagggtgtttacaacattaacaagggttatgctgtattcaagcagattgatgttttatatcagaacgaggaatatacgatcgtaaagacaggtacaacttatggcatcgcattatacgaccatattgcgttagatgggacaaagattgatgaaaatcagctgatcaaataaagacaacggcgaaggagataaaatcaaatgttaaaagataatttaaaaaatgtagaagaacgtgtacaggaagcgtgtgaccgcgcaggaagaaagagagaagaagtgacgctgatcgctgtcagtaaaacaaaaccaattgagatgcttcaggaaatttatgatgaaaatatcagggatttcggcgaaaataaagtgcaggagctctgcgataaaatcgagaaaatgccaaaggatatcaaatggcatatgatcggacatctgcagagaaacaaagtaaaatacattgtcggacaggttgcactgatccattctgttgattcctaccgtctggcagaggagatcaatattcaggcaaagaagaaaaatatcattgttccgatccttgtggaggtaaatattgcgcatgaggaatccaagttcggtatctccgaggaagatgcgatccagttagtggaagaaatcgcagaactggaaaatgtccgcattaaaggacttatgaccatcgcgccatacgtggaaaatgcagaggataaccggttgtatttccgtaaaataaaagatttatctgttgacatcgctgcgaaaaacatagataatgtatctatggaaattctgtctatgggtatgacaggcgattacgaggtggcaatcgaagagggagctaccatggttcgtgtcggaactggaatttttggagcacgcaattacaacaaacaataatgcaccggataccagtaagagaaagaagcagaatttaaaatcagtttaataggagcagcaaaaaatgagttttcttgataaatttttaaatgtgatgcgtttgaatccggatgacgatgacgatttttacaatgaagactatgattatgatgacgaagaggaagaagtaaaaccaaaatcttcttttaagaaacgtgaaaaagaggatacttttaccgatgattacaaagaaaaaccggtaaagaccactccaaaagtcacaccgatccgtccgtcaaaaaaacagcagaatctcgctggtatggaagtatgtgtgatcaaaccgacatctgttgaggatgcaagagagatcacggagacattgttaaacaaccgcacagttgttttgaatgtggagggattagatgtagagattgcgcagcgtatcattgactttacctctggttcctgctttgcaatcagcggaaatcttcagaagatttcgaattacattttcattatcactccggcagcggttgatatttcaggtgatttcctgaatattgtagactcttttgatacgaccagaggactgtagagaacgacattatgaatgagcaggaactttgcaaaaagaagttaatagatttatccagacaggcaaatagaaagggaatcgttttattcagcgatttccttaatttaaatgaactgaatatttaccaccagaacgaaaagttttttgagacaaagacagaagcttctggaggtgttccttttgcagagcgtcagatagttgcatttatacctgatgctctttattatgagtggcagtttccaattgcatatcttgagattgttccatcttatccaaagtttgcagaaaaattaggacacagggatattttaggttctatgatgaatcttggtgttgaccgctcaaaattaggcgatattgtaatctgtgaggacaaatattttttaatctgtgaggagagcatggcgccttattttatggcgaatcttgataaaatacgtcatacagttgtaaagctatctcctgtgtcagcagatgcgttaggacagcagcagaaatttgaagaaaaagatggaatcatcacttcgaaccgtttagacagcatgattgcatgtgtctacaaattttccagaagccaggcattggaatttttcaaggcagaaaaagtatttgtgaatggcaaatgtgttcagaatccatcctatcgctgcagggaagcagatattatctcggtgcgcggttatggacgctttattttcgaacgggagatgggcgaaacaaacaaaggaagaatgaaagttcgctataaattatatggataagtgagggctatcgttatggcaaaagatttaccggtaactttagatggaaaagtgatctatcacatcaaactgacagattcctttcaggggttggcagaggagttaaagcagcttggatatcaggctgaccagaaaatctgtattatttcagattcgaatgttgcaaaactttatgcagagactgtgaaaaatatcttagcaaaaagctttccacagattttctgttatgaatttcaggcgggggaggcgagcaaaaatacagataccgtcaatggtgtttatgaatttttaatacagaatcattttgaccggcatgatcttatgattgcattaggcggaggcgttgtaggtgatctcaccggatttacagcagcaacctacctgcgcggcattgattttatccaggtaccgacttcacttctttcccaggttgacagcagcattggcggcaagaccggcgttgatttcatgcagtataagaatatggtcggagccttttatcagccgaaacttgtatatatgaacttaaatgtgttaaaaacattgccaaaagaccagcttatctctggctttggagaaatcttaaaacatggtctgatcaggaatcacgattattttctgtggatgaatgaacatgagaaagaaattcttgcattagattataacactctcgaggaaatggtctatcagagctgcctgatcaaacgggatgtggtagaacgtgatccaaaggaaaaaggggaacgtgcgctgcttaatttcgggcataccatcggacatgctgtggagaagctttcggattttggattgtcacatggtgtctgtgtgggacttggcatggttgcagcctcttatatttcctgtcaacagggaaatctcacgaaagagcagctatcctttattgaggagacattaaagcattttggacttctgatccgtgtatccggacagaatccggatgatgtattaagaacaacgaagctggataaaaaaatggttggaaaccagattaagtttatcctgttaaagacaccgggagatgcctatattgaaaaaaatctgaccgatgaacagattttggaaggaatattttatatttatggaaaagaaaactaatactttaaaaaaagcactgacaggaatcattctgtcggtcattctgattgtgattgatcaggtcacaaaattaatggcaatccatggattaatgaatcaacagccctttgtgatctgggatggagtatttgaattacactacctggaaaaccgtggagctgcatttggaatcctgcagggaaagaaaatcttttttgtgatttttacgctggtcgtactctgcatgatcgcatatctatatctgaaacgcattccggatgagaaaaagttccgtccgatagacggtatctgtatcctgttttttgccggagcattgggcaattttattgatcgtgttttccgcaattacgtggtcgatttcttttattttaaactgatcgattttccggtttttaatgtagcggatatatatgtgacagtcgcagcgtttgcaatgatcattctcggattgttttattataaagaggaggactataataaaatttttcatgattaacgttctgcacagcaaatatgcagacctgctgaaaaataaggatcagtgatatgcaaaaagaaacatttgaagtagaatacgaatatgagggcgagcgtctggataagtatgtaagtatcctttttccagagcaatcgcgctctttttttcagaaattaattaaagatggaaatgtctctgtcaatgacaaggttcagaaggcaaattaccggctaaaaaccgaagatctggtgacggtagaaatcccggatgctgtagagacacagattcttccggaagatatcccgctggacattctttacgaggatgatgatcttttagtggtcaataaaccgaagggaatggtcgtgcacccatcagcaggtcattacagtggcacactggtcaatgcgattatgtatcactgcaaggatagtctttccggtatcaacggagaaatacgtccgggaatcgtacaccgtattgatatggataccacaggctctctgattgtctgcaaaaatgatgagagtcatgtttttattgcagaacagatcaaagaacacagtgtaaaccgcagataccggggaatcgtctatggcgttgtcagggatgatgagggaacgatccatgctccgattggaagacatccggttgaccgcaagaaaatggccatcaatgaaaaaaatggaaaagatgcaatcacacactataaagtcttagagcgttttgataaatatacttacatggaatttaagttagaaaccggaagaacgcaccagatccgtgttcacatggcaagtattgggcacccattattaggagatacgctttattccaatggaaaaagtccctataaattgcagggacagacattacacgccatgaccattggatttattcatccaggaaccagagaatacatggaaatctctgcaccattgccggaatattttgaaaaaatactacgtgacttacgttaaaatactacgcattatcttgatataaatggacaagaagtttttacagttacaatattatggaaaaatgttagaaaatttaaaataaatctttccaatttttgataaatacgctataataaagataaataaaaaacttgcgtaaaggtgggattgatatggcaaataaaatatatacgatcggtagagaatttggcagcggcggaagagaagtaggtgaaaaacttgctgcaaagcttggtattaagctttacgataaagaacttttacagcaggctgcaaaagacagcggattttgtgaagagatctttgagaaccatgacgaaaaaccgacaaacagttttttatattctttagttatggatacatattctgtcagtggttattctgcagcaccgtttttggatatgccattaaatcacaaagtttttctggcgcagtttgaaacgatcaagaaaattgcagaaaaagaatcctgcgtgattgtcggacgctgtgcagattatgcattatctgataaccctgattgtatcaatatttttattcatgcagacttggatgtacgtatcaaaaatgtcagcaggaatctgaatattacagagaataaagccagagatatcatcaataagacggataaacagcgtgcaagctactataactattatacaagcaagaaatggggagattctaagagttataatctttctcttgatgctggtaagcttggcaccgataactgcgtggaaatgatcctgaagttcagagaattgatggatgcaatgaaataaaatgaatcatgaagtttataatctgaattgaaatgtgtaatccctcatggagttttccatgagggatttttgataaaaagccgttgcggaacgttgtctgaatctgggaatgtaatcccgggaaaacacattgagtaagccaactattcgttaaacttgtgttttgcgaataaatagattcataaagcctcaatgctgccaccagcggatgataaaataaatattataaaatcctttgcagccatttgttttcaagggtttaacatatttcagcagaatctaatatgattgtaaatggaccatcgtttaaaagcgaaattttcatatcagcgccaaagattccctgttcaacaaccggaaattcttttttacactgatcaatgatatattcgtacatttgctttgccatatcaggttttcctgcgtttgtaaaggatggacggtttcctttcctgcagtctgcatataacgtaaattgggaaattaaaagcaattctccatttacatcattcagagacagatttgtttttccatcagaattttcgaaaatacgcattcctagcagctttttgatcattttatcggcaatctgtatggtatcatgatctgaaattccaatgaggacaagaacccctttttgaatgctaccggtgatgtttccgtctacgatgcaggatgcgtttgtgacacgctgtattacaaatttcatgtgtgttaatctcctttgatgataaattgtatgcaatttatttactcataaaatatgaagtattcaatcatacaaattttataagtcaaatgagcgattcatttgtaatttacatacaaatttattataatagatttcagtgttgaaatacagtcttttatttgggaaggcaattagaaatggaattacaacgattactgagtttaacaagaaaagccatggacgattatcagatgatccaggaaggcgataaaattgcagtgggaatttctggtggaaaagactctctcactcttttgtatgcaatggcaaatttgaggcagttttatccgaaaaaattttccctgatcgcaattacggtagacctaggctatgaaggctttgatctgacaccggtaaaactattatgcgaacatttacaggttgaatatcatatcgtttccactgaaatcgcaaaaatcattttcagtgataaaaatgaagcatcaccctgctctctctgtgcaaaactccgcaaaggtgcattgaaccagaaaattaaggaattgggatgtaataaggttgcctatgcgcatcatatggatgatatgatcgagacgatggttttatccatgatttttgagggcagattttattctttttccccggtcacttttttagaccgtatggaattgactgtgatccggccaatgatgtatgtatcggaggctgaggtcaaaggttttcgtaataaatataatcttccagtagtggaaaatccgtgtcctgtcgatggagtcacaaaacgtcaatatgcaaaagatctggtacgacagatcaatctggatcacccgggtgctaaaaagcggatgtttaccgctattttggatggaaatattccaggctggccaggaaaaacaaaacatgaaagaaagggacatcaatgaaagaaaaggcctattatgaaaaagtaaatgtgaaaaatgagacattgcttcgcaatctgctccagaaaatgccgccgtattgcaaacaattttttattggtattgaacctactacttcttcccgtacccggattgcgtatgcatatgatctgaattgtttttttgaatacctacatgaaaataatccattatgtaccaaaaaggacatcacagaaataccactatctgttttggggaatttagcccctatggacattgaggaatatctctcctatctgaaatattatgaaaaagatggtgtggaacatacaaatgatgagcgcggactaaaacggaagcttgcttctctccgctccttttaccggtatttatataaaaatgagatgatcggacaggacccggctgtgaaggtagatatgccaaaaatccatgaaaaaaccatcacccgcttagatattgatgaagttgcaaacctgctggatgaggtggaatcaggggaaagtctcacagaaaaacagcagaaattccatgaaaaaacaaagaaaagagatcttgctatgatgacattactgcttggaaccggaatccgtgtttcagaatgtgtcggtcttgatatggatgatgttgattttaaaaataatggaatcaaaattcaccgtaaaggaggcgcagaagttgttgtttactttggtgaagaagtaagatctgccctgatggaatatatggtcgaacgacagaaaatcactgccgcagatggcagtgtaaatgcacttttcctgtctttgcaaaacaagcggatcagcgtgcgctctgttgagaaaatggtaaataagtattcaaaactcgtaacaaacctaaaacatattaccccgcataaattgcgcagtacctatggcacatcgctttaccgcgaaacaggcgatatttatcttgtcgctgatgtgttaggccataaggatgtaaataccacacgaaagcactatgctgctattgatgatgaccgccgcagaagtgctgcgaaatatgtgaagcttcgtgaaccgtagataaatgaattaatatgcccagcctgatttgtcaatactgattttgtattgcaaacctgactgggcattcttgtgtaaccggacaaatatccttatgcctgacgcatataataaataactcctccaaagaatccgatcccgattcctgcatagcctgtaatgatcactgtccactccacccattcagcactgtatccacagaatacacctgcgacaaagctgagcagaaaagcgatacctgaccacaatataatattcatgatcaaaaaaatatttgctttgcttttgttatctaatttttttgcatctacatacttccataatctcatcataaacaaatcaccagacattctttaaattttaaaacatttttttgttttctttagtattattatctgcctgatgaaatttgctttctatcaacaatatttaaattttttgtaaaagataggtaaaacttatttttcctgcttttcagtgatttttaataacatggaaattttacggggaacagactcgcaacagggtacttgcctatgccgtggagcttacaggcatacaggacgggaagatcacgggcaatctctatgagctggactaccagcagcattataagcacgtcaccgaacaggcattacccgctgataactatatgcttatctatgagcatggggaacgggagcagccagcggcgcgaccctttgacgcttcccccaacccacagcttgggaagtttgaacgctttgaagcaatccccaatgacccggaagccctgcaatccctgttacgggaggaaaggcacagccgggaacagtcggcggttccgggggacttggaaacgcatatcgcagtactacgcaacgggctgatcgaaacggaagcacggcgcattgtagggaaaatgaaagaattaagcgactcgaacagcccggataaatctcatttcatggtggagctgtccccttactttacgcagatcgttaccacaaaggacaccgaccgccttttttctatgctaccctataagaccctttcattttcacagatcaaggacaggcacggcacatatgcgctgatcggcaaggacgagaaccgggacaggcggataaggaagccccgcccctctgtccgggcgcagcttgcacaggataaaaagagaaacgccccgaaaaaaacggcggcgaaaacaaaaaatcacggattggaggtatgagcatgaacaaatataacaatttcacggtagaggaaaccaatcttttgagtatctacatgacaggcagcaaggaggggcttgtcgtggctatgaacgccgcgctgccctttatggagggggaaatgcgggactttgccgcccgcacccttgccaaagtgggacgcatgaccgaagcggagtttgcggggctggccgtttaccccgccgacgaggtatgagcgacattaagcggctcacgccgccccaaagccggaaagtcaactcccttgtacgccggacgtgctgcaattatgatagcggaaactgtatcttgcttgacgacggggacgagtgcgtatgcccgcagcttatttcctattccctgctctgtaaatggttccgtattgccgtactgtccgcagataaggagctgtacgccgagctttaccatgcggaggatatgcgctgttgtagtgtgtgcggtgcgccttttgcgtccagctccaaccgggcgatttactgcccggactgccggaagcatatcacccgcagacagaccgccgagcgcatgagaaaaatgcgggcgaatgtgacgcgataggggcaaaataagccttgatttatgcggctttccgggcgggaaaatgaaacagtaagggatttatacttttacccccgaaaatgccgtcctattgcgtaacaatccaatctttgcacccataatcagtaccacccgtcaaacgggtggtttgctcagcggctataagcctttgttaccggccagcgcctaaagacgctggctttcactttcgttcaagctactaatgcctttgactcgccgctgcccttaaaagggcatttgtattactagcaacccttaaaagggtcttcgtattcttttacacttaatttatccaaagctatatcatgtttttcctgctctttgatgtatttctttattgttgcttcatttaatcctactgtactcacatagtatccttctgcccagaaatgtctatttccatatttatactttaagtttgagtgcttgtcatatatcattagtgcactttttccttttaaatatcccataaactgtgatatactatattttggtgtgaatacaatatgatatttacacatccattttgtatgtgccatagaatttgtttgatttgccattaaaatcacttttcctttcgttaaatagtagcctgaacaactctattttagcggaaaggtgatttttttgtataacaaatttgttgcaccacccgcatagcaggtggtttattgtttcgcacatctccatttctccgttgggagaaactccgatgcactcaacaggctaaagcccataagaaaaccggggcgcggttgctatatgatagctgccgcgtcccggttttttctaattgtagacactattatatcttaccaaatgttctaattgttcttttatttcactacatatttgttcattttccaaatcatcaatatccacacgtattttgaactcataatcaccagtattttctatatccttaataatctccccttgaactaccatagttttcttaatcatttcttgtttataatcagtatacataaaatcgaaatactctgtacactctatcccacaaaaaaaaccttgctctattattatctcttggattttatctacccattgtgtgactggttttggttctaatgtgctatacatttcaaaactattcgtttcaaagtcatatgtagaaaagtctttttccaaatatccccctaaaagaatatacccttttcctaaataatcatattgttcatcataaacagcgacaataagcactacatcaccaaacacattcccatactttatatctccaccaacatttttaataacatatttcattttatcctcatcagcttctatatctaaaataaaagcgggttgtttttctaaatcttctatccgttgttcgttcaaagatatatcatttgcaaccattgcaactttaacactaacgattgacactataactcctgcaatagaaagagctaacatcataactgtttcaaagtaaattttctttctctctaaaaaagtttgaaatttacttttggtatcagcttttacttcaagtagctttgtgttttcgttatatatcaaatatttacttttttttttcttgttttcatgcttacacctgctttctaaatctaaggacatattcattttatcataattttcttgttttttccacgatatagcaccttattaccgttctgtttctctttttcgttccggctgcttctctgcctgtaaaatgctgtctatgttccgcttgataatgtcatattcctgtacctgttttttcagcttgacataatcggcataaaggctttctttctgcccttgcagcttttcatactctgctggcagggcgggaacgctggggagcttgccgccaatcagcgccgcctttaatgcctttgccgccgcttcatggaggataataccccgttcatgctctgcccggtatttctccttattccgggctttgcggtaggcttcatagaggggctttgtcttttggtaggtagtgacattcttaatgagcaacgccatatccgaaagacgcttttccgcttcctttaggctgtcccccgcctgttcgcttgccgtggcgatttcctctatccgggtaagcagatcggcgtactgttcgatcttgttttcggtaaggaagttcatagtctttgccgcctgtttcagattgtggattttcgcccactgttcatagccccggctctgctgcgccttgatactgtttctcaatgtcaatgagaagattaacgcccctacgctctgcctttggagctttggcggcgcgggtgcgcttgcccgctatccgttcccttatggcttcttctgtatagtctgcgccgagggtttttaggtgggtaaagcgttcctgccccggtgcgcggcatgacgcatattttcccggcttgatctcatagcccgccgcctgtaaccgctgcaatagttcctcaaagctggaaacttggggaatgagcacgtccacggcgattttcagcttgcctttccagcttgtcccggttttctccgcttggtattccgcatagctttttcctttgctgcccttaccggggacgacgacggaaagcccgttgtcccggcacagcttgtcactcatgttccgtatgccgtaatacgtccgtttgttggaaacgtacttgtgatgatctacgaagttgaccgcgcagaaaataatgtgattatggatatgtcccttgtcaatgtgcgtcgtgagtacatactcatgctgcccctttgttactgcgtcggcaagctaccgcccgatctcatgggctttctgatagtccacttcccccggcgcaaaggactgtatcaagtgaaaggctaaattgttacacttatcccacgcttgcgagaggctatagccgaactcaatatctgccgtttcatagctgcacccgaaagaggatatgagcatttgattgtctgtcttgtccgggttttcgatatagtcaagggctttgcttagagtgcttttaacaggcttaatctttgtaaccgccatatttccgcaagcaccccccttgatttcctctatatcctctttgcaggcgttccccgtcgcgtttacgcgacgtgcgatctgattgacattcaccccgattttctgtatctccgctgtcattgcttttatgtccgtgtggtctacttggataatgtacccgtcaatagcgatcttgcgcagatatgccgccatgttgtttgtggggacgagcttcattttttcctcaatcaagctccgttcttcctctgttacatagaatttgacctgtaccgtccttttgcgtccgttcatggtttttcgctcctcattctcatagagggtttgggacacttcccaacaagcaatttctgaccgaccgggcgggcagaaatacggaaaagggtactcttttcctatgcttgctaagaaagttttttcctcacttatcactacaatgaaactcccagtatgccaaaagagagcaaaagaaaaacgccgcaatcctgcgacgcttcaatcactttatgcagacaaaaacgagggaactttattcccccgtcctgtcgttgttggcttcctctatgccttttgcagtagcagacatgatttttaagtccgtttcgctcatagtgtcaagcatggtatcgagctgacggcggcgtgtggacttctcctgttcccgttccgggaaaaagaactggtctactgatacgtcaagcagggttacaagctcatacaaaatctgtaaacttgggtgctgcccgctgttctcaatggacgcgatatatcggggcgcaatattcagcgtgtcggctaactgattgcgtgatattccctttgcttttcttgctgctttaatggcttgtccgaaagccttaaaatcaaatttctctttactctgcttcataatcatttcacccagttacattttaccgttcacctttctttcaagatatgaatacacatatcatagtattgatagtaatagagcataaaacatgcagagtaaggttgctatcactcatactgccatatataatatctaatgacatcgaaaattaaagaaattgattagaaatagatttttgtttgataatctaaaatcagatatttacaagggaggtatatttatggcgcagagtattttaattgtagacgatgaaaaagaaattgtatcaatgctgtattgctatttcagcaaacttggatatacggtatatactgcaacagcaggaaatgctgcattaaaagaagtagaaaaaaaacctgacattattttgttagacgttaatatgccagatattgatggatttactgtttgtgaaagaatacgggattatgtttcatgccctataatttttttaacagcacgcattgaagatagtgataaaataaaaggattttctattggcgcagacgactatgtaataaaaccattttctgttgatgaattagaagctcgcattgcagcacatcttcgcagagaaaaaagacacaatacatcttcaaaggtgcaatttgatgaagatatggttatagattattcctcacgtattgtgttttatcataataaggatatggcttttacaaaaaaagaatttgatataatatctttcctttcgcaaaacaaaggaattgtttttgaccgggaaactatttatgaaaaagtttggggattagacggcattggtgataatacagttgttacagaacatatcagacgtattaggaccaaatttttatctttaggcgatagaccttacattgaaactgtttgggggtgcggatataaatggaaaaattaaagagaagcagattgttcaatcggttaaatagcatgagtattagaatgtcctttgttctttatgctttgttttcgttgttgattggaataattatttgtatatttttaatttcaatggttgacagatacagaataaatttaaactataagtatgaaaatatgtcaacaaggtatgatataccggaaaatggctcatttaccgccacttatagtaatgaccaaacaaaatatacaatatttgacacgaaaggaaacgagatatgcaagttcaatgttgattatcaaaaagaacgcccagtacacgaatatgtctatccgaaccatgtttcatatatcgaagttttacctaattttacaagtcgggataggcttattgacagtgctttaggttcattaaatattgcaattattcctatcgtattatctattagtatgatatgttgtgtaacatttttttataaaaaaaaattatcaaaacccattaagctattaactaatgcgtatcataaaattgaagcaaatgacttagattttacattatcatatccattaaatgatgaaatggggaaactctgtcacgcctttgaaaaaatgaaagattgtttgtcgaaaaataatgaaactatgtttagacaatttgctgaacagcgccgtttgaatgctgctttttcacatgacttacgcactcctttgactttactaaaggggcatgctactatgttgctttcctttattcccaaaggcttagtatcacaagaagaaatattagacgaaatatcagtaatgtcaaaaaatatttcacgtcttgaaaaatatgtaaatgctatgacgaacttatacaggttagaggatattgatattccgcgacaacagattacatttcattcacttattgataattttaataacacagcggaagcactttgttatgacaaacatttttcaattactgcaagcggtgataatataaccttgtttatcaatttagatacagtcatgcagatttatgaaaatttactctctaatagtattagatatgcaaaaagtgatattgctattagcgtagtaatagagaataataatttggttatatctgtttcagacgatggttgcgggtttaaaaatattgagattgaaaaagcaacattaccattttataaatcatcgaaagatatatctactgaacatttggggttagggctgaatattagtaagattttaagtgaaagacatggcggaaatatccaaattgctaataataaagcagggggagcatgtgttacagtgaaaataaattgcaatgaaagttgattgaaaatagacattttattgctattataaatttaaaagaaaggagataatgacaaatgaaaaaaataatatgtatgtttctaactttattgctatcggtgtgtattgttgggtgtagtcaaacaaaggacagtgataatcatgtagtacaagattattccgaagaatatgaggtttctccttatggaagtgaagaagcacttgacactttggacgatttgaaaatttcaatgagtgcagaaaaggatttagacttaaagcacctttcatttctaatagaaaatacttctgataaagaataccgatattcaccaaattattttgaaatagaaactgaacaatccggcacttggtatcaacttgaacagcttgatgacccttcaaagagcaatgaaaaggattgttttattaagcctaacgaacgattaacattagaaattgatgttaaaagtttttatggagaattgcctgctggacactatcgtttgattaaacaatttgcgttctttgaaagtgaaagagattgggattacgatacatataatttatcttgcgaatttacaataagataaaaattttctacttcataagcatgaaataaaaaaaaccgcttatgaagtagaaagttctcatgccattttaacggcggttttgaaataacaatcaaaaccgtcgttttcttttgaaaatctaaaacagaggacatgttaaaatcctgctatttggggacacggcggtatcaaggaggtatcgccatatccttttttctataccctaatgggttactatcaaaaaagcccttatccaccgacgggttattccggctatgtagatgaactgtcaaatcaattaaataccgctgttatttcctatgcgtctgtctgcattttgcaggcaggcgcatttcgcattttacagaagatttttcaaaaactttgccctctttttggcaaagcaaaaagtcgcctgtattatctcgcgaaaaggggaggtactaccgcctttcggcagaaaggaggtgaacaccatgacacctaatcgcagggaatttgaaaagcaatgtgcgttatttcacatcactgatcttttcattgatccggttcctgactaatgctgctatctcctgtgtctttaaagagccatattcctcgaataaaataggttttaaataatgtacctgtgttgtaaccggtccaagccagaaactgttaaatacacggtaagaatcgaccaaagctaccgggataatcggcgctttagttttcaatgcaattttaaaactgccggctttaaagtcacagacatgattgcggttattaaaatcatacccaccctccgggaacaggatataacattttccattcttaacatcttccgatacttcattgataatggtcagcgcctgacgtacatcttttttatccagccgctttccttccaacagatcaataaactcttttacaagaatggtattggattttgccttatccataacgatggaacaaggtttacggtgtgtgtaaacaattccaagcgcatcatacttgccctgatgattcgggtacatcatgtaaccgccctctttcggaagattctcctgtccatatgctttcgtatggattccaccggtaactttcatcagacggatgcaatgtcttgccagctcatagcgttcttctgctgaatacttctccggatggtcagcttccctccgcatctttggaatcatgtaaggggcacggaacaggttcagtaaaataacatatataaatcgtaacatagaactaaatctctctccaaataattactgtttcatcctatagcatgtatggaacatactttacagttgaaacaatgactattataccttatttcaggcaaattgacaacttgccggcacaggaagaaaaaacattgcttttcactcacaccttgttccagtaataattcgcagccctattttattgccctgcaatggcaatactgctgtaatatgggatggtaagatattgtcccgcatggatctcattctgagaaatcttattgatagagcagacttcgtcaatataggcattcatatcacggtattcctctgtaatatgatcggatgcgatcgaccataaagtatcaccgctctgtacttcaatacttgtataatatttgcaggaaatctcagatggtgctgcctgagtacggaccgcaccagataaaaatatacagatgatagttgccaatgcaatgaatgcgaccgaaactaaagctatcttctgcctgcggacaacgatacgtctgtttctggatacatcaccagaatgcatccggctggatgtattgccagacatctgacaggttctgcctgtgattgtattgctctcatttctcataacggtacctccctggatcatcaattgtaaatctgtgttataaataccccgaacacttgttgcgaacatttgtttgtacaactgtatcttactattcgaacatctgtttgtcaatagaaaaatcgaacaaattttcggaatatatgtttgcatttcgatatatggtatgttatcatgattaatagataaagaagcagtggttaagaagctgctggatcattacagaaatcccatatataaggagacaatttatgccaggtaagattagtgcaaagcaaaaagaaattttagaatatatcaagggtgagattttaagcaaaggttatccgcctgcagtccgtgagatctgtgaagcggtagatttaaaatctacttcttctgtccactctcaccttgaaacgttggagaagaatggttatatccggagagacccgaccaagccaagagcaatcgagattctggatgacgattttaaccttaccaggcgtgaggttgtgaacgtacctattgtcggacatgtcgcagccggagagccgatcctcgcaacagagaatattgagaattactttcctatcccggttgaatatatgccgaatgaagagacttttatgttaaaagtaaaaggagaaagtatgatcaacgccggtattttcaacggcgataatgttcttgtcaagaaacagccaaacgccgagaatggcgatattgtagtggcattggtggatgattccgcaacggttaagactttttacaaagaagacggttattaccgcctgcagcctgagaatgatacgatggatccgatcattgtaaaagaatgttcgattttaggaaaagtgtttggggtattccgttttctataattttaattaacaggaaacaaaaagcggcagccgatctgtcttacagacaaccggctgccattttatgattataattcacttacatccacaacttttccatctctccaggttctctcaagatcatagaaaagacggtcttcttttgaaaaaatatggataataatatcaccataatccattaagatccaggtagaactctggtttccttcaatctgctggacttttacgccggctttgtataaggcttcatcggcagcatcacgcattgcctggagctgattctggttggttccgtttgcaatgataaaataatctgcaatcggagaaatttcgctgatatcaataacagttacatcttctgcttttctgtcttccaaagcagctactgcaagtttggttaattcttttgatgtcataaaaacctccatgttaaaataaatttgatttctgatcaggatcagatggtttctttgtaatgtttataaaattcataggtcatctgtgttgtcggatcaatgtttccaccacgctttttcagataaaccaatgtgtcgtgcaatatttcggccatacagacatctaaatcatgaaaggctaattccctcacgcgatctaaattagccgctttattgcggtttggttcgatgtaatcagcaatataaatgatcttgtctaaaatattcatatccggctcacctgttgtgtgcactttaatcgcatgtaaaatcaatggatctgttacatcatattctgttttggcaagcaatgcaccaagttttgcatgaagcaaaaaaggattttcacgttctacggatgaaataagaatgtcgttttcttcacatagtcttaatttttcatcgtttggaatgcattttgcacagtcatggagcagaccggcaagcatggctttctgcatatcatagccgtacgccatagcgaggcagcctgcggtgtacatcacacctttggtgtgctcgtagcggtctttatcctgtactttttttaatttttttcgtatttctaccagttccatattgttatcctctatcaaaaattgattggaaatattaaaaaaatcatttctcattttcgtaaagatgatgttcttttataaattggctcactgcatacggaagcagctgcccggtatcttcccctttttttatcatctggcggatgtttcttgaggctgcatcaaaacggtcacaggaaagcggatagatctttgcatgaaataactgttcgatcgcatggattttctttttgacatcctccatattccagtggtcgcgcactgctactaatacaactgccttttcacagatgatctccggatgtttccattcctcaaagtagtcgagagaatctgcacccatgataaaataaaatatcgtatccgggtaacggttctttaattttgtgagtgtcagataagtgtaacttgtctcttctgcttctatctctaccgtagacattttaaaatacgggtatggttttactgcaagagcaaccatctcggcgcggtattccggaagagtcataccgctttcgtttttgttcggagaatgtccggctggaataaaccagacttcgtccagatcaaaatctgtgtaggctgccctggcaatggcgagatgtccattgtgtaccggatcaaaggagccgcctaaaataccgattttcctgcctgataaatgattcatgatcgctgtcctttatagtgttttgaaatttattttacaggtaattcgtattttgaattcttttttgcctgacggaaaagaatgatttttttgccaatcactttcacaacgacagaatgtgtacgttctgcgatgatctcagcaatttcacgagggtcatctgcacagttttttaatacagaaatcttgatgagctcgcgtttttccaatgcctcatctaaaccattgataagttctggggtcagacttgcctttccaatctgaaatatagcgttcattgtgcttgcttcgcttcctaaataagcgcgctgtttgcttgtaagattcatattgccaattcctttcttttatttgtaatattcaaaggcatgtccgtacatcttcacggtgtcgccttcctggattccatgttcttcgagatcgtctaaaatgccctgttcttttaagaaacgctggaagaacaggaaacctttctcagattcgatattcgtgtaaccgagcattttttcaatcttagggccttccacaacgaaagtctcatcatcctccattgtgatcgtgtaagggtcatcccggaagaaacgcaatgccggatcgtattcctgctcgtaaatgacaggttctctgccacatgtttccaaaagctggctcacatggtataaaagctccttcagtccctgaccgctgactgcggaaatcgggaatactttaatgccgtctttctcaaactcgtcttttaatgctttgatgatttcattttcatcaccgtagatggaatcaattttatttgctgcaatgacctgtggttttttcagaagttccggatcataagcggcaagttctttgtcaattgctttgatgtcggcaatcggatcacgcccttcggttccggcggcatccacaacatggatcatgactctggtacgctcgatatgacgtaaaaactcaagtccaagtccaacaccctcggaagctccctcaatcagccccggaatatcggcaatgacaaaacctttggcaccatctaagtcaacaacaccaagatttggctgtaatgttgtaaaatgataattggcgattttaggctgtgcattggtcacgcgggataaaagcgttgattttccgacatttggaaaacccacaagccctacatcagcaatcacctttaactctaattttacttctatctcaattccctcaccacctggctgggcgtatttcggtgcctgcatggtggctgttgcatagtgggaatttccctgtccgccgcgaccaccctttaagatcacctgacgtttgttgtcaccggacatatcggcaatgaccttgtctgattccgcatctttgatgacagttcctgccggaacttttaagatcagatcagcgccatctttcccatgacatttctttttgccgccttcctcaccgttttcagcagcaaatttacgtctgtgacgaaagtctgtcagcgtattcaatccctcatcgacaacaaaaataacatcgccgccgcggcctccgtctccgccgtccggaccgccatttgggacatatttttcacggcggaaactgacatgtccatttccaccttttccagattttataataattgttgctctatctgcaaacataattttctcctttaagcggacagccaggctgccctgctcgaatgccaaaacaataagaacccggctatctttacaaatagtcgggtccattgttcatcttattattcagctactggataaacggaagcctgtttcttatctcttccttttctctcgaatcttaagataccatctgttaaagcgaataatgtgtcatctccaccgattcctacattaacacctggatgaatctttgttccacgctgtctgtaaataatattaccagcttttacgaactgtccgtctgctctcttagcacctaatctcttagattcagagtcacgtccgttctttgtagaaccaacaccctttttatgagcgaaaaactgaaggttcatattcatcatgtcttacacctccttgaatgttagaatgatataatcatttccataagtattttgtattccttgcaagcctaaaaccagggatttcatgagcaaatcagcatcatgacttgccggagcatcaaacctgagtgtgatcattccggtctcttcatcagaatctgtagaaaatttttccttcgtgtaaacaccaagggaattgatcgtgttgatcaccagtgcagaaattcccgcacatacaatgtcttcaccttcctctgcataccctgcatgtccaagacagtcaaaacctaaaaatgcctgatcctggtttctgaaaatcgttatcttagtcataacaatcttcctatcgattacgcattaattttttcgattttaacctgtgtaaacgcctgtctgtggccgtttttcttgtgataaccggtttttctcttatacttgtaaacgataacttttttcgctctgccttctttcactacagaagcttctacagttgcgttagctacgtctgctccaactttcattccgttgtcagaaactgctaatacctgatcaaaagttactttctcaccagcttcaacaccaagtttttcaatggtaatgatatcaccttcggaaactttatactgtttaccacctgttgcgataattgcgtacatatggcacctcctattatcattactcgccagttgtggtttctgcaaacatgcagaatttgagacctcactgtgcggcatacttcgttactatagcataacaattgaattacgtcaactggttttttgaaatttttctaacctttttagttaaaacctatttttataataatgatttttattcacatacatcttctcatctgcaactgacaaattcttttcaatgtcctttgcatgttctaaccagacacttccaatggaagccgaacattcagccgtccatagctttgaaagcttttgcagcttattttgaaagtctgtctcgcttttatcgaatgacagaatgataaattcgtccccgccaaaacggtaacaacctgcctcctggaatatggttatgatttttttcgcaattgctgcgagcagctcatctcctgcttcatgtcccagattgtcattgattttttttagaccattcacatctgcaaaagcgatgccaaccggctggttacacatctcctcgtcacattcgatgattgcaatatctttgtaatatgccttacgggttttgaatcccgttaatgcatcccgctctaattcagatatctgcgaattaatctctatgtattgctgtaaagattttatatggttttctttcgaatattcaataatccggtctttataatagtttttcgcctctaatgcctctaaaattgcgtctttgtccattttaccaacagcgtatacatatattaattctgcaaattcaagtccaaccttgatttcatccggatatttttccatatactgattcatggatcgtaaaatgtggttcataaggttatcatcacaagaatctcttccacactcaaacagttcccggcaggcatccataaattcagccgcgtacatttcatccatttttgaaaggatctgttttttgtaagtctcatatttttctggctgttccaatttataataaagtgttgctgcacagcgggtgacatcatcaggaacgattgtatctgcatgatattggctcactccaagttcaaacgcctttaaagcctctgttaaacggttcagtttctgaagtgaaatagatttattgatatagatataagcacccatttcctcatcacagtctttcaggacgtcttctgcgagcgcaagacttttaagtgcttcctcatagttttgttcctcaatgtaggtcaatgcaatattattatactcaaatgcataatagtatttttcatcattttccatggcaatttttaatgccgtttcatagaaaaaacgggaaacattatattctgtctcgcaatgtgttgccacacctatcaggttaaaacaggacaataacttaggggtatacggatagctttgatagtccactatgattggttctataatctctatggtttttctgaaatttccttcctgataaaatagctgcccataataaaaacttgcaagtatgcgcacttcggttttgtcgtatttctttttcaatagctgttcataaaaatttttctgctccgcaatagacagttttttgatttgctgttgtctggttaaaaaatcgttataattcatattcaacattcctcatttatctttcgaatcacacggcatggatttccaaccgcaacacaattggccggaatatcttttgtcacaacacttcctgcacctattgttcccatactgcccaaaagctgctttaatacttctgctttttcttccttttgattataagaaaactccttacaaaatttatcttttggaagattcacttcttatttacaaaattccctaattcaaataatatcatatcatattagacacaagattagtacaataaaatgaaatatctgcatatgtagatatttatactaatgttaactagcttttacaaataaatgtcaacttctataagtgagcatgttgacaattaaccatacttcgtgctactttaaaaacaattgaatttagaaacttgtgaattcataccgtaacttatttgaattttgtaaacgtaacaaaggagtacaaaaatgacaacacaaccaaagacaaccgaagccgaaaatccatatcttaccagagaggatgctcttgcaattttaaatacaccggatgatcagttggatgagctgattgcacgcgctgagaaactgcgccgcaaatacaaaggagacaatgtcggaatccacattctgacaaacgcaagaagcggcaactgctcacaggactgtgcttactgcgcacaatcctgccgttcatcagctgatattgagaaatataaatgggtttccgatgagaaactttaccgcgacaatgattttgtaaataaaaatcatctcgcaagacactgtatcggattgagcggcatgaaattcacagacgccgagattgaagaactcgctgcaaaaatccgtaaaatgaaagaaaccggaacacacctctgctgttccatcggatttttgactgaaaaacaggcgcgcatgttaaaagaggcaggacttgaccgtattaaccataacttaaacagcagccgtgcattttatccgaacatctgctctacgcatacgtttgaccagcgtgtcgcaaatatcaaaatgctgcagggattgggttatgaaatctgcagtggtgggatcattggtatgggggaaagcaaagaggatgttgttgatatgctgttagaactccgtgaaattaacccggaagcaatcccgatcaactttttgctgccaattgagggaacacctttagcacacaaagatacctcaggcttaacccctgaatatggtcttaaggttctcgcccttgcaaggcttcttgttccacaggcagacatccgctgtgctgccggacgtgaggtttactttaaaggtgaagaaaaacgtttattgtccgttgtaaactctatttttgcatccggttatctcactgaggatggtcagggaatcgaggataccatcagggtgatcgaggacgccggatttacgtatgagattgaatctgcataaatctattaaaaaagtgagcagaccttacagtgtggctgctcactttttttagttcatctttaaactgtcccgcaaagatttcttaatcttctttctggtcacttccaccagtcctagtctggtcatgtcgatcagatccgttttcaccgggtcgtcttttaaatatgtgcggaattcttttaaaagaactgcctcatcttcttttgcaagaagattgataaaatcgatgatgataatgcctgagatattgcgcaatctgagttgataggcaatctctttcgctgcctctaaattaatacggagcagattttcgcgcatctctttttttatgatatttttcccactgttcacgtcaatgaccgtaagtgcctctgtgtgctgtaaaacaatggatgcaccggactttaaccagatctgttcccttaaagccttttctaaggaggacttcacgctgtagagggaagataacgttaacatcggatcatggtaatacgttaacgtcagggaatctgctgttccagagattgtcggcacctgaaactgatcgaccggaaccgggacagaaccgtttgtcataaactgttttggatgaattccataatccatacagattgtttcaaagagtccgcggtcatcggtgataatctcgctgacagaaccttcccgctggtttttaacgtcttccagatacgttggtctcgcttttttcagaacactgtaacaggttttatggcagacattctcacgcatctgtgaccattcctgctcaaggcttcgaatctctgcaattagtgtttcatctgcgacacttgcggcattggtccggatgataagtccgtagctttctgtatcaaattcgtgcaataattccttataatgtgctttctgctctttatttaatttggaagaaattccaagcctgcggtttccgcttgtaagaacagcatattttcctgcaaagcttaaattcgcagtgacagcaggttctttcgtctttaaagcttcacgttctacctgaaccagaagctcctctcctgccacaatttcttttcttgcagagagctttttggtaaaatgtgcatttttcagatcatctaaagacaaataacaggtctgctccggcgaaatcttcacaaaagctgcccggatattctgtacgacattttccacacggccaatataaatgtttccaagtaaactatcttcatccgggggtgtaaggcttacttcgatcatttttttgccctgattataaagagcagagacaataaagtcctgctcttccctgttttgcatttttattttttcatgtgtgataatatatttattcataaagaacctctttatgcgatctcttcgcccatatccagtagagaaacaaatttgtccccctcttttgcatacacatccaaacgatggatctggattgcattggtattatatggaatgttcatatagccgaaaagggattctaacacaagttccggttttaagttgtcggaacttccggtacagagattgatgtaaaactccggtgcctcctcggttccttctactttaaaatcataaaccagctgctttaagtccatgattttttcgcttttctttgtctgcttggtgataagtacctcagaaggcgtgataaaataatctaaaatcgcctgtttggcttctgttttcgtaaatggtacttcataaccttccttaaaaaaaagtttataatcggctgcggcaactaaggacatcgctgtcttggcattgtccggaagcttcacatatccggtgatctccacgccctctaccatcgtcgcatttaaatctgccatcgcctcttttgtagacttgctttcgtgtacttcaatatctaaatattcgccgtcacttgtaattccaacgccgagcggtgctgcaaacgacatgatctgatgaggggaaaatccctctgaataacagatatcaatatctgctctccgcatcgccttctggaaatagcgcataatatcaagatgtccgatgaacttcatcacaccagattttcgaaatttaatccttattttcaaaacagacacctcctccaaatttcatggctccacagccggaacatttcatacggcagttcggggttactttttcatcatgtgcattcttccattcacgttttaaaaactctttcgatacgccggtatcaatgaaatcccatgggaagatctcatccagatcacgctctcgcattgtataaaaatcggtatcgataccacattccgcaaaagcgtcctcccatctctggtagtcaaagtattcgctccacgcatcaaaaatgccgcctttttcataaacttttaagagagcctgtccgatcttacggtcgcctcgtgccagaatcccttctaaaaccgtcacatccgcttcgtgccagttatatttgatactcttatgattcagctgcgcatgcacaccctcattgacaacccgcgctcttgcaagataatctcccggtgtgtacatcctcgcccactggaacggagtaaatggcttcggcacaaagaaagaggtactgatcgtaatctgacattttccattccgtttttccttcggaaccgtgtcataataaagagctgcgatctcattggcaagctgcgggatcgctttcatatcttcttccgtctcggttggaagtccaagcataaagtataattttaccttgttccagccaccttcaaaagcaagtctggaaccatttaagatcacctcttcggtaagacctttgttaatgacatcacgaagtctttgggaaccggcttccggtgcaaatgtcagactgctctttttgatatcctgcactttgctcatgacatccagcgaaaaggcatcgatccgcagggaaggaagtgagatattcacaccttttcccttgaactcatcgatcaggaaattcaccagttcttccagttcagaataatcggaggaacttaaagagcttaaagagatctcttcgtgcccggttgattttaacattttgtaggcaagatctttcaggtgttctacatttttttcgcggaccggacggtagaccattccagcctggcagaaacggcagccacggatacatccgcgctggatctcgagaaccacacgatcctgtgttgccttgataaaaggaacgacaggtttttccggataaacagcttctgtcatattcagtacgatctgcttctggatcgtttttggaacatcctcataaattggttcaaaggatgcgatcgttccgtcctctttataagtcacttcatagagggatggcacatagataccaggcactttagaagcttcatgtaaaaattcatggcgtgtttttccctctgcacgcatttttttataaagatcaaacagttcgtagaaagaaatttcaccctctcccatataaaacagatcaaagaagtccgccatcggctccgggttataagtgcagcagccgccaccgatcaccagtggatcgtcttctgtacggtcttttgcaagcagtgggatctgtccgaggtctaaaatctgaagcacatttgtgtaacacatctcataattgagcgtaagaccgataaaatcaagatttttgatcggttcctgggactctaatccaaacagtggaatatgctcttctttcatgattttatgaagatccggccatggagagtaaactctctcacaccacacatcttccattttattaaacatatcatataaaatctgaacgccaagatgtgacatccctatctcatatacatccgggaagcacatggcaaaacggattgctactttttctttatcttttttgatactgtttaactcatttccgatataacgtgccggtttatcgattttcatcagtatctcatctgataatgctaattttgtcattcggtttgtcctttctcatttttcctgaaaacgactgggaaatcagtcatgctcatttatcataacataatcctgcaaaattgtataatactgattatcagaaataatgtcaatgacatcttttgcctgatagccatggaattcatatgcattatattttaacagaaggaatgcgagcataagaagaactgcaagcactatgcggattttcagaaaaatccacggaaccaaaggctgtgattcctcttctgcggtgccgttttccacctccggccggtcaaacgagcgccgtatctcgttgacgtaagctctgcgtctttccacatattcatcggtcataaaataagactccatagatttctcattgaaatcatatgaagtcttgtatctcattagaactttttttctatccatgcaataagcaacagacaccagtggatcagcgttcgatcgagaaccattgcacctatcagtgaaaaaaataaggtgagcacgatcatgagcagcgaaccaccgatcactccgaaatctgtcgggctgacatgaaaaatctgtttgaccagataatgaagcacgccccagtggatcaaaaggatcccgaaactgtagcggctgatcagctttgtaaaaaaatgttccgtctctgctttcacataaatctgtttcacgaaaagaaaaacagccatcgtataaaataccataagcggcgcattgttaaataaataacgatgatattgtgccccactgaagatatgacggactgccagacagacagaaaggattccggctccataaaagaagtactttctgcgcccctgctctcttgtcagataatatcccaatataaaaacaccagcaaaagaaccgagaatcccggagacaatggaattataataaagcgtatcccagtaagttccaaggatctggaagatcaggatcacagccacaagcccgcttaaaacagaatccgggatatgctgcactacatagcggaaaaacggtgtcagcacatataaccagatgatcacataaatcagccagaaatgcggcgcttcctccggtgcaccgagcagaatacgttttaacatggcgccccagtgatcggggcgaagccagacgaacccctctttggcacacacatataaaatataatagatcaccattggaacaagcactttcaaaaaacgtttccggtaaaactgcccggcgggttcgcctttcaccggtaaaagaagggctccgcttatcatgataaaaagcagattgcagcacaaaaacaggtaattgctgatctcaaatccataccacaccgcactccgctccggaacaagcgtggaaccgagtgagaccgtgtggacagcgatcacgagaaccgtggcaagtacccgcagtttgtcgagataaacctgtcgttttattttctctgtgaaagttcctgtgtgatctcttcccatgtgatatccttctctgccattaagaccatgagatggtaaatgtaatcagagatttcatatttcaaatgctcgtggtcagtatttttcgctgcaataatgatttctgtgttttcctctccaacttttttgaggatgttatccagacctttttccaataaaaggtttgtgtaggagccctctttcggattttccctgcggtctaaaataatattgtagacatcccccaacaccttctgcggatttttttcaacgtattcttttttcacaatctcattgaaaaaacaactctggtttccggtgtggcatgcagcaccgatctgggaaacttttgcaagaatggtatcataatcgcagtctgctgtcagggatttgacatactggatatgaccggaagtaagaccttttgtccaaagctcattccggcttctgctgtagtatgtcatttttccgatgttaatcgttgtgtcaaaagcttcctcattcatgtaagccagcattaacacttcatccgtacggtaatcctgcacaatgaccggaaccatgccgtcagaatttttctttaagtcactccactttaagtttggctcgaagttatccatcttaataccggaggcagacaactgggatttcatctccataatatctgtttttggattattaattaaagaacctgcaattccgcggacatttttgcgggataagattgataaaacctcatcataatcagcatcgtttaagtagacaacatgaggaacatcggtcattccttccactgcatctaacactgctttatttaagatcagcacttcatggaatgtatcagccatttcatcctgatgtttgaagataaaatccacattcgtcacggaaacaagaatacggtctttcccgaaacgcttgcttgcctctgcagccagtgccatactctccggtttggagccgttgacgatcacttgaagacatccggcatagatgaacttcttaatgtcctccatacggttaatgttaccgcctgcacagactttgatttcaatattacggttaatgttgcggataacctgtatgttgcgctcatgctcttcatctgttgtggacaggtcaaaaatcatgattttatcaatgccactgtcattatagagttttgcaagttcaatgacatccggatattcctcgtaattgtctctggctttgatcgcttttccatcctttaagtaaattgttgccacgatatttttgtgttccatattaatattcatacctttccatacaaaacggtctgcacatatttttgatacgtcagaccgcttcttttctaatcatatttcgcacgtgatacatgtgaattgtcaactacagacttcctttggtagaaaggatatccgtgatcctcgggtcaatgaccgttgcctgatccagtgcctttgcaaaagccttgaacatcgcctcgatcatatggtggttgtttccgccggaaagcaccctgatatgcagattcattcctgcggtataagaaatggcatagaaaaattccttcaccatctccgtatccatatatcccacgcggtcggtcgtaaattctccatcgaacacaagataaggtcttccggaaagatccactgcgcacaggacaagtgtttcatccatcggcagaatacagcttccgtagcgccggattcccttcttgtcaccaacggcctccttaatggcattgcccagaacaatacctgtatcttcaattgtatgatgacagtccactgcaagatctccggcaacattgactttcaggtcaaacaggccatgtcttgcaaatccgtctaacatgtggtcaaaaaaaccgatccctgtatggatagaggaactgccggtaccgtctaaattcaaatgtaatgatatatctgtctctttggttttacgaacataatctgctgtacgtgccattttattttaaacctttctgcttcttttttcaacttaagtaattattaattctttgtatctattcagagccaaggcaattttcataaatttgcgaatcatgcttgcatgaatgagcataattttgaaaatttctttggcgaagtaaccacatgagcaaaaggaaagctctgaaagagcggttttgcgaatgggtgctgaatagatacaattaatcttcaaaccgtacccggatggaatttgcatgtgcagtaagtttttcacattctgcaaactgcacgatatctttgtatacaggctctaacgcttctctggaataagagataatgcttgatttcttaatgaaatcatccacgctgagcggtgagaagaattttgcggttccgttggtcggaaggacatggtttggacctgcaaaataatcaccgagtggttcgctggaatactctccgataaaaattgcccctgcgttgcggatttttgtcattgtctcaaatggattttttgtcacaagctctaagtgttctgaagcaatctcattgacggtgtcaatggcatcctgcatcgtgtctgccacaaggatatatccatagttatcaagggatttccggatgatctcttttctggaaagaacctcaacaaatttatctacttccacagaaacctgttctgctaatgtctcgctggttgtcacaagaattgcggatgccatctcatcatgttctgcctgtgacagtaaatctgccgctacaaaacgtggatttgccgtctcatcggcaagtaccatgatctcacttggacctgcgatggaatcaatgctgacataaccaaacactgcttttttggcaagggcaacgtagatatttcccggtcctacgatcttgtcaactttcgggatgctctccgttccaaaggcaagggctgcgattgcctgtgcaccaccgactttataaatcgcatcgactcccgcctctttggcagctactaatgtagatggataaacctttccatctttgccgcatggcgtcgtcataatgatattggaaacccctgccacttttgcaggaatgacattcatcagtacagaggacggataaactgcttttccacccggcacatacacacccacagtttttaacggtgtcactttctggcctaatatgataccggattcatcggaatcaaaccaggagtactgtttctgttttgcgtgatagtcacggatgttgacaagtgccttgcggatgacatctaaaagctttgggtctacctgctcataagcttctttgatctcttcttccgtcacgcggatattgtcctgatcgatggtggcaccatcaaattttaatgtgtactcaaaaatcgcctcatcacgtttttccctgacattctggataatgtcattgacgcggctctcaaattcgccgtaagagttcgggcttctttttaataaattctccaatatattattctgtgtttcttttgtcagttttaaaattctcattggactgcattcctttctgtattgatcacattcttcagatcagagatcagttttgtgatccgctcattttccatcttcatgctcacctgatttactaccatgcgggcagagagcggacacacttcctctaacactgtcaatccgttttcccggagtgtggagccggtctctacgatatcgcagatcacctcggacagtccgacgatcggtgctagttcgatggagccgtttaacttaatgatctctacggtctgatgttttttattgtaaaaatagtcttttgcaatgtgtgggtacttggttgccacacggatcagttcgtggtgctgtaacagatcatgcgcttcttttggtccacagatgcacatcctgcattttccaaatccaagatcaagaacttcataaatattacgtccttcttctaatatggtgtcttttccaacgattccgatatcagccgcaccatattctacatacgtaggaacatcaggtccttttgcaaggaaaaaacgaagttttagttcctcgttgacaaaaataagttttcttgtgtccttatctttcatctcctcacaggtaataccgatctgttcgaataattccagtgttttttttgcgagtcttccttttcccaatgcaaaggtcaagtatctcatatcttccattttctaatcctccataaaagtaactgtcctgatacgattacgctttgcatagttttggtaatcttcgtttgttttcgtgtcgtcctttaaaatcgtctcgaccggagtcccggccgcacgcttttcttttgcacttaaaatggctttcgcctgagctgcctttgtatacacgatcagttcaccgttcgtttctatggtgatattgattttctgtctggataatgccgccattaactggtcaatgacaatcgcaaatccgatggatgcggaagtctttccataataggtcagaagtttatcgtaacgtcctccctttacgatcggttctccgcttccgaatgtataaccggaaaaaataataccggtataatactgataactgctggtaataccaagttcaaaggaaatatacttttgaatcccatagacttcaagtactttatgaagttcttctaaattatggatcgccgctaaaatcctagggtaagaagcagccgcttctttcgcacgcttcaggtcgtttaggtccacattcagactgccgagcatatggaacagctcgtttaactctgccttcaggtttaaggtctccgcaaattcctccacaccaaaaaaattcttgttggcgagcagttcacgcagttcttcctcgtcctcctcactgatcccggcagcctccacaagtccctgaaagaaatccgcatgaccgacacttaactggaaatccttcagtcctgccttttgcagacattctaccgtcatcgataaaatctccgcatctgcatccacggtgctgtccccaatcagctctgcaccaagctgcgtactctcttttaatctgccctgataactgctgttattgataaacgtatttcccatatagcagagacggataggcatatcctcatccataaaatattttgcagccgctcttgcgatggacggtgtcatatccggtcttaagacaagcgtattgccctctctgtcaaaaaacttatataattctttcgagggagtggttccgatctccttcccgaaaatatcaaaaaattcaaaggtcggcgtctggatcggatgatatccgtaaccctttaagatgccaagtaaatccgactggagtaatagctttttctcacattcctcgttataaatgtcacgcacaccctccggtgtatgtaataattgttttttcataatgaatctaatacctttcccttatgctcatcccatgcggatgatccgttcacaggtttcattttgtacactttagtatgctaatgtggtagcaaatgaaactgcttgatttattatatgaaaagaatatctgcttgtcaatccctcattgccaaatctttttgcatcgcatccagatatggaacaaggacgcctctgctcttccggagaaaaaaatcaggctccagttcttcatagcggaagctttttctgccaccctcttttgcccggttccaaaattccagcagttttgcaaaccgcagataataaaattcatctcttgcagtaaaactgatcaaaaaaaaggcaatgcccatctgtttttcaaagttctccataaagactacctgatgctcatgtatattctgaagcgggaaagtgtctgtgttgcattcttttgcgtcaaaacagaccgggatcccctgcactgcgccaatgtaatcgacggtactcttctggtcaaaatacgccagcgtaatatgtctggttgccttatcaatattaatgggagtgattggagtcgggactttctggatcaaagccagtccgttttctaaatatttttcgttggtgcggttgataaattcctctaaagtagaacctcttaaaccacgtgaattccacgttgccatttctatttcctgccttcttcgcttcttttcatgattatatcataacttttgcatgacacgccagaaaaatgaaaacattgcacgctgttttcttatatcccgaatgataaatttttattaaatattcaattccgatttgtaaaaaaatgggttgtatgatatgattattttatatacatttatcaaagaatcatacattgataaatacagaagttttgtgggaggtattatttttatggtaatgaatgaatcagttgaaaattatctggagaccattctggtgctgaatcataggctgggaaatgttcgttccattgacattgcaaatgagatgaatttcaaaaaaccaagcgtcagcgtagcaatgaagaatctccgggaaaatggctttattaccgtaagccctgaaggatatattcaccttacagaatccggacgtgaagtcgctgagaagatttatgaacgccataccactctttcaagctggcttgtcatgcttgggggtgatccccgcattgcagcagaagatgcatgtaagattgaacatgatgtcagcgccgaaagttttgaagcgatcaaacgtcacataaacagtgtttccaagtaaaaaacgttaaaaagtctccgggggaatatttcactggagacttttttctgtcctgacagaagatgagaacatgcgtttgcgtttccggatttatgcataaatgttttcataattttatggaatgtgccgatatacaatacaaagaattggggaggtcattcttatgcaaataaatctgaacattctcacagagaacaatcattcttccttactgtcaaaaaatgttccaacggctgataacgcacttttacaatatatgcaaaaagtcacgcagggcacgaacaatgcggacacggaagataaaaagcagcagaaactgcagcatattgtaaacaaattaaagcacggcaaaaaactgacggcacaggagatggaatttctgcggatgaattatccggatgaatatcagcatgcactccgcattcagaaaatggctgaaatgcttgaaaaccagttaaaacatgcaaaatctaagcaggaggcagacagctatattgccgcagctttaaatggaatcccggacgatgatccggataaagaatgtctggttgcagctttcaatgagatttccaaagaatttcaccactcttctgcttaccacagacttccggacacaccggaggatgtaaaaaaacagcggaagaacaacggtgacaatggatttaaacgaaaagcagacgatgacagcggctccgataattccggcgatctgatgtcatggacaccattgcaggatattatcgatgccgctccaactctggaattaaaaggctgatgtctgtatatagtcccatgcatcctcaaattccctgccggacggtgcgatcacttctcttccgtcttccaatacaatacggtaagcatgaagcagttgagaacgaacatgaacctctttacggaaacgttcgttcgttctcagatcaccatatttcccatccccgacgatcggatgaccgatggacgcaagatgtgcacggatctggtgggatcggccggtaataagatggacttcaagttccgtatatccattcgaaactgccaccgggcggtattccgtttcaattggcagataatctgctttttcctccgggcggatatgggaaacaactttcaccttattgttctgttcatctttggacaggtagcctttcaaatgcgttttttcgcgcagctctccttttacaatacaacggtaatatttctggacagtacgtttttttaacgcttccgccattgtctgaagtccctttaacgtttttcctgcgatcaaaagcccggatgtgttccggtctaagcggttgcagatggatggtttaaatgttttgaactgctcctcacttaaggcaccttttcggatcaaataagaaagaatatattcatttgccgaaatatcctccggaaccgccttctgtgaaagcatcccggatggtttgttaataatgatcacatcatcatcttcataaacaacctgaagtctgcctgaatcaatggactttaacttcatgtagccggaatttgtctcatctttaccggaaaatttttcaaaagtttcatcggacaaaaataattttacaaggtctcccgcatttaatttttctgttccatctgctttgcggtcatttaaggtgatattctttttgcgcagcatcttgtatacaaaactgccggatgcattgctcaataatttttttaaatatttgtcaaaacgctgcccggattcgttggggctgatcgtaaactgtttcatataaagtcaggttcgctttcttattttttctttctgacagatctttgaggattgctgtgatccgcacggttctttgcagatttattcatgttcgttccagaggctttcttgttatgcacattccggatagtctttttctttgcaggtttctgatctgtcctgcccttttttccatcatggcgcatattgcgttccccatggttttgatactcaccctgtcttggacggatcagacatttcttatcaaatccgatcagatctgtccttcctgcttttaccagtgcctcatagacaagatcgtaattcttcggattccggtactggatcaatgcgcgctgcattgccttctcatgcggattgaccgcgacatagattggctgcatatttctcggatcaacacctgtgtaatacatacaggttgagatcgtggaaggggttggataaaaatcctgcacctgctccggcatatatcccagatccctcaaaaattccgcaagctccactgcctccttcaaggtggaaccagggtgggaggacatcagatatggaaccagatactgctttttaccaatcttttcattcatatctttataggcttttacaaaccggttatagacatccacacccggcttgcccattttctctaaaactgcgtcggaaatgtgttccggtgcaacctttaactgtccactgacatggtgctcacacagttcccgcagaaaagtgcggtcattatcataaatcagataatcgaaacggatacccgaacggatgaatactttcttcacatttggaagctcccgcagtttccggagcagtttcagataatcggaatgatccactttcaaattttggcaaggcttcgggaaaagacactgcttatgcggacaggcaccttttgtcatttgcttgtcgcacgccggcgcacggaaattcgcagtcggaccacctacatcatggatataacctttaaagtcaggatcccagatgatcttgtttgcctccgctaaaatagattcgtggcttctcgtctggataattcttccctgatggaaagtcagcgcgcagaaactgcagccaccatagcagccacggttgctgatcagtgagaatttcacttcttcaatcgccggaactccgccaagttctttataagaaggatgataatctctcatataaggaagtgcgtaaacggaatccatctccgactgtgtcaatggttttgccggtgggttctgtacgacaaacagcttttcatcgtaagtctcgaacaaccgttttccggaaaaaggatcggtattgctgtactgtatgtaaaaactctttgcatactctaatttatctgcttttaaagcctcaaaatgtggcagttcgattgcatcgtaaatgctctcacggtctctcgtcttataaacagttccatcaatgaaggtgatgtccttaatatccagaccgctgtctaaagcgtccgcaatctcaacgatactgtgttcacccattccataggagataagatctgcaccggaatcgagcagaatggaacgttttaacttatttgaccagtaatcataatgtgccagacgacgcaagcttgcctcgattccaccaatgatgattggcttatgtttataggtctgtcgaatcagattacaatatacaatcgtggcataatccggtctttttcccatcacaccgcccggtgtaaatgcatccgtggttcttcttttcttggaaacggaataatgattgaccatagagtccatatttccggctgaaacaagaaagccgagccgtggttcgcctaaccggttaatggattctctgtctttccagtccggctgggcaatgatcccgactttatagccatgagcctccaaaattcgtgaaataatggcatgtccaaaagatggatgatctacgtaagcgtctccacagatatatacaaagtcaagctgttcgatgccagcttctttcatatcttctttactgatcggtaaaaatccatgactcatttgtgataacctttctatctaaaaataaaattttctgcaaaatagcaaccttaacattataacttatttattcacaattttcaacgcagtaatctcttcctctgtgagcgggcgatattctcccggctttaaatcatcggtaagctgcaatggccccatggaaatacgttttaaatataaaaccttctttccgactgcctcaaacattcgtttcacctgatggaatctgccttctgtaattgttaactcaatttctgattctggttcactttttaggatgcgtaatttgccgggttttgtcagcttttcctctccaatgtcaaccccgttttcaaagctgttgacatctttttctgtaactacgccatcgataactgcatagtatgtcttttctacatgttttgcggggcttaacagatcatgtgccaaagccccatcatttgtgatcagaagcagaccttccgtatcaatgtccagccgtcctactggaaataaatcagagcgcaccgtatcggtcaggtaatccataaccgtcttatgcagctgatcttccgttgcagtcacacaccctgccggtttataaaaaagataatattcgtattcacagtaagtgaccggttcacctttataagatatctggtcgttttccggtgcaacctttgtttccggttttgtaacgatctctccattgactgtgatctgttttgttttcaaaatcttctttacttctgagcgggtaccaagacccatctctgttaaaaatttatccaagcgcataagttcgttctttcctttttctattgtctataatgatgtggcattttcctgatcgatcattccaaatttcataaaatgtataaaattattttagcataggtctgctttctattacaatgattttaaataacggagcagggggaaggggttcacactgaactcattccctgattcatcatcaaaatacactccaaaatgaagatgcaccggaaaatttccggttgtacccggagtatcgctatacccggtatctcccataaagccaatcagagttcctgctttcacttcttctccgatctggaaatcttttgcataatccgagagatgtgcataataaaaataagcgccatgcctgctccggattccaatgcggtaaccgccaagccgcagccatccgatattttccacaaccccatccgatacgctgtaaatcggataaattccacgctggttcacagatgccataatatcacagccttcatggaaccggtctcctccaaaggttctgctctgtcgccatgaatttgcaaagtccacggttgctccgggttcattttcaattgctcctaccggaaacaaaaccgcatccgtccacatcgcttcaatcttgctttggatccgttcaaatttttccggctgatgttctttcacaaaagaaatattttcttctaataaatcagaatccgaacaggtattatttaaggcgaagtacattgcaaggtattcactgagctttgcgaagtctgcatattttatagatttgattttctgttccgtaatagcattctcttccataggttccgaatcatacagaaaagaatttattacctcttctgatacttcttcatctcggaaattttcaaacgctgtttcataaggaaaacagtttttcttaagcacttcactatcaatgtagattccaagatatacattaataagaaccaccagcataaaaagtaacagatcacgaagaaatctctgttgcagcaaaatcacatccccactctttcctgataaatgttacgaaagttacaaacaaattacattttttgcaattcaaaacaatatattttactatgaaaaagaaatttatatgctttgccattcttattttaactgcatatatcctgctttatccggcagatgctgtaaatgcatccagaaatggtctgatgctctggtatgaaaaagtgcttcccacccttctgcccttcgacataatatccaatgttttgattcattctggctacatggatgccctcacaaagcacctgacgaaatatttccgtttctttatgcctgtcagcggggaaggcgtatttattttgtgcagcggttttttattcggctttccaatgggaagcaaaaactgcgccgaacttttaaaggcaaataaaattcatccgaaagaggctgaaattttattttacatcaccaataacatcagtccggtttttatcggaagttatattttgttgcagcagttacagctcacaggaatgttcggaatcagtattttcatcctgtatgtccctgcactgatactcggtatgttattattgtacagaaaaaaagaggaaaacaggcagaaaaaaacggcatcccaatctcaaataacttttaagatcatagatgccgccattatgaacggtttcgaaacacttgtcaggatcggtggatatatcatgctattctcaattctgatctcactggtagaaaagcttccgttgccaaagcctgtcctgatcctgttggaaaacgttcttgagatcaccaacgggatcaactgtctcgccaacacagattggagtattcaaaccaaatatatccttgcaatgaccgccaccgccttcggtggattaagcggtatcgcccagacatcttccatggtaaaaggaacctctctgtccatgaaaaaatactgtcttgtaaaactgtttctcacactatgtactttcctgctcgctgtcgcagtcagtgtatttttattttaacatatcagaagaaatgtcaatcttaggcagattctctgtgttgtctgaaacagcatcctctgccgccggatttaattctgcacggttggaagatacaacatcataaaactcctgcagtgatgacatataattctcatgtcttgcctttgcagaatccattgcatgagagattgatatctccagatttcttaaaatatcatctgtatactgcatagcgcccatacggatattgtttgcatcgttggtcgcattatctaaaatttcctgtgcctgcttggtcgcgatcataacaacttcgtttgcctgcgcatatgcctgctgcatgatctgatgttcacttacaagctcgtccgttttcacctgggcttttgcaatgatcgcatctgcctttgcctgtgcatctgctaaaatagcctctttgttgctgatgatcttctgataacgtttgatctcttccggtgttttggaacggagttcatttaaaagttcttctaactcgtccttgttcacaataatttttgaagaggataacgcctgatatttacaaccgtcaatatactcttcgatttcttctataatctgttcgattctgcttgccataggaaacactccttatttcgatatgttatattttgcataaattctgtctataaactgtgcaggaacaaacttggaaatatcgcctccgtaggatgcgaattccttcacgatcgtggaacttaagtaggaatactgaaggctggtcgtcaaaaaaatcgtctcaacttctggattctctacatgattcgtctgtgcaatttgcaattcatactcaaaatctgtcactgcacgcagaccacgcacgataatcgtagcatcaatctgcttcatatgctctaccaaaagtccgtcaaacgatgtaacagacacatttggaagatcttttgtcatctctttaatcatactaacacgttcatccagagaaaacaatgagttttttgcactattgttcagcactccgacaacgagttcatctacaatattagatgcccttttgataatatcaacatgtcctaaggtcagtggatcaaaactgccaggataaattgcctttttcataatgtatttgcctttccagactgcaaatcataattccaatgatagaaattatgatgatttattctgcctttgtaataaaagcgtgaacatttgtcttatatgtttttaatttttttaatgtaaaaccaagctcacttaaataatcaaaagaagtgtccaaagatgcctcgacaatgatcagcgtatcttcttttaaaatagaggaatcttttaaacattccaaaacttctttttcatactcgtgcctgtacggaggatccatgaaaatgacatcaaacttatactttccttccatgctgcggatggcagaaatgacatcgctctgaagtaattttgtttccctgtcaaacttcgtaaaatgaatattgtcctcaatacatgtacacgcttttttgttattttccacaaaaacagcatatcttgcgccacggctcactgcctccaaaccgatctgtccgcttcctgcaaacagatcaagaaaatacgaacccggaacatcattctgaagcatattaaataacgtttctttgatacggtctgttgtcggtcttgtgtccatgccttcaatcgttttcaaaggcaggcttcttgctgtaccagcaataattctcatatttttcggttctccttattttcagaaaatctattatgctttatcgttcttagttctgttcttttagaacatctttgttctttacaatgtaatcaattaatgacacaactgtaagaatcagggcaacataggtaagaatcacgcccagaatctggaaaaatgacatctgaatatttaaaataagcacgatcaccataagcatctggaatgtagttttaaatttgccccagtaacttgctgcaatgacaactccattgtcagacgcgatcaaacggaatccgctgatgataaattctcttgcaataataataacaacaatccatgctgcaagctgtccggtctgaatcagacagatcatcgcagaacacaccagaagcttgtccgccaaaggatccataaactttccaaagtttgtgacaagattatactttcttgcaattttaccatccagaagatcggtaagacttgccacaataaagatagccactgcaatgtaattattgatgcctgtcatatctggtgcaagcataaaaaatacaaaaaatggaataagaattacacgaaaagttgttaatttgttaggtaaattcataatttttccttctttccgaaatctactgacagatttctccaattaaatcatactcataagcgcctgtgacttttactttaacaatgtcaccggtcataagggtttcgtccgtgttgatgaaaatatatccatccacatccggtgcatcccggtaggttcttccaacataggcattatcatcctctacctgtccttcgataaacacataaagttctctgcccttcatctcttcatttttatcaaagatcacttcctcctgaagttccatgacatctgcctgccagtccttcttcagttcctcatccacctgatcttcgaaggcagcagccggagttccctcctccggtgagtaggtgaatgctcccaaccggtcaaactccatgtcattgataaactgcatgagttcctcgtgaatctcctgtgtctcgccagggaaaccacagatcaacgtagttctcaatgtgatatccgggatacgctctctcaaatgtgtgatgatacgaaccagatcgtcatgacttgttcttcgtcccatgcgctttaacattgtgtcattggaatgctggatcgggatatcaaggtaatggcagactttctcgttgcggatcatggaatcaattaagtcttcatagatttcttccggataacagtacataatgcggatccagaataaaccattgatcttatttaattcgtccagcaatttgtgcaatgatttttcaccgtagaggtcaataccgtaaagagttgtttcctgggcaactaaaatgagctcttttgcgccgtttgcaacaagctcttttgcctggccgatcagatcttccatcggtacactgcggtaattgccgcggatatatggaatgatacagtaagtacagcgtttgttacagccctctgcgatctttaaatatgcgaaatgaccaccggttgtcacgcttcgctttgtatggatagacggcagtccctccaatgttttgaaattctcataaaaagtaccgccaagcgcctcatgtacagcttttacgatatcctcgtaggaattggttccaagtatagcatccacctccgggatctcggtcttgatctcttccttgtagcgctgtgcaagacatccggttacgatcaaagcctttaacggaccggtctttttgtactctgccatctctaaaatggtgttgacactctcttccttggcatcattgataaagcagcaggtgttgacgatgataatatctgcctctgtctcatcattcgtgatctcgattccgtcatcacggagcattccaagcataaattctgtgtctactaagtttttgtcgcatccgagggatacaaataataatttcattcgattctctctttctacattaattatggcaaaagggctgtcgcacaattgcgttcaaaagtgcggcagccctgacgggttttctttactcctcatcttctgtgtctggaatgatctttactttgccctcgtaaagttcttctacagcgatggataatggctttggacatgtgatcttgtctgccattggttcatctcccgcaatgatctgacgtgctctctttgcagcagcgatcacaagggaataacggctgttaacaactggttcctcaccaaattccacattgttatttacaactttcattaattcaacataggatggatgtatcataatattacctctcttctgccttgcggctgattcactttcatttatttttatcaaagatatctgatttccgatatctaatgtaagcttttttccatgtttttgcaaacattattttaatcttttttcgaaaaagcggttaactggtgtctcatatcagaaattgcagacaaatttctggaaacacggaaatgttcattgtggatgatggaatgtacttcttccacacacgcatcgagcttatcgtttacaatcagataatcgtaagcttcaattccctgcgcctcctcaactgctctggaaagtcttgattcgatgacactcatctcctctgttcctcttccaaccagacggctctttaactcctctgcgcttggcggtgtgacaaacattaacagtgtgtctgggaacttctctttcacttttaaggctccctgaatctcaatctccaaaataacgtcttttccggcagcgagctgttcctctacatacgccttcggtgttccgtagtagttgtcgacatattttgcatactcgatcagttcatcatcggctatcattttctcaaactgctcttttgtccggaaaaaatattccacaccgtctgtctcacccggtcttggagatcgggtagttgcagagatggacagcgcatactgatccgaatatttcttcatgagttctttcataatggttccttttccagaaccggaaaagccggaaagtacaattaaaattcctttactcttttgtatcatagtcaccctccgatgcattgccattaaaccggccggcaagtgtctccggctgcaatgcagacaatattattttattattttcagtaaaaatcacgctcttggttcttcttccctgcgtcgcgtcgatcaaaatctcctgctcttttccccgggagatcatacgctttgccggtgcagaatccgaagagataatgctgacgatcttatcggtgttgaccatattgccaaatccgatattcattaactttgccataaaatcgttcctattcgatattctggatctgttccctgactttttcgatatccgttttcaggttgatcccggtatcagagatttccagatcatttgccttggaaagaatcgtattcgcttcgcggttcatctcctgcgcaatgaaatctaacttgcgtccgatgctgccaccagcctccaaagcatctttcgttgcattgatatggcttctcaggcggacagtctcctcatccacacagatcttatctgcaaaaatcgtcacctctgtggcaattctcgcgtcatcgatctgtttatcttccaacagctctttcactttgttctcaagacgttctctatagtccttcataatgattggagaacgctcctcgataaaatcaacatagttcagcatattgtcaagctttgcacagagatcattcttcaaatgctctccctctttgatacggctctccacaaactgttctgccgcaccgcggagtgctttctcaagccctgcccatagttcattctcgtctgtctccacctgttccatcgtgaaaacatccgggtatctggataaggtgctgactttgatatcattgtctaatccaaacttgtctgccattgcagtcaggtgttttaaatattcaccggccaattcttcgttgtacctcaaacagaaattatcttcggaaaaatcctcgaatgtgatatacagatccaccttaccacgctccatatattctttcagcagattgcggatcgtgctctcaaagaaattcaacgccttcggcatcttgatattcacatccagataacggtgatttacggatttcatctcaaccgtatatttacggtttccttcggtcacttcacatcgaccaaatccggtcatgctttttatcataaaataaccatgccctttctcgtaaaatgattatatgcatagataaatttattataaagcgaaagttcatgctcgtcaatatttttccgtaaatcagcttcgtgttttcgttgttgttcactcgtaccgcattcctgtaacgatccgcagactcatttttgttttttgaattccctgtatattttttgttgcagacgtcatactaggagtaaatattgataccaaaatcattcatacaaagcaaaatcaggaggaagcgaacatgtccgatagcgataccgtaaaactgctccgcgaatgtaattccggcatacagatggctgttttttccatcgatgaaattttggaaaaagtaaccgataagaatttatacgaaattttaaaaaaatccaaagaaaagcatgagaaactcggtgatgaaacacacgcaattcttacagaatgcggggatgaaacaaaagagccaaacatgctggcaaaaggcatgtcgtggatgaaaaccaatgccaaagtcatgatggatgacagtgacgccacaatcgccgacttaatcgtagatggctgcaatatgggcattaagacgctctgccgatatgaaaaccagtatgcagcagctgatgacgctgcaatgaaactgaccgatgatctgatccggctggaagaaaagctgcggcaggatttgagggaatatttataacgcaaatcaaaagggaagcgaatgtatcataatatcatttcatacgttcgcttcctttttatctaatccaaaatcctaacagactttaaatacttttctcttcgcttctgtctttcctataatcatacaagcccttaaatgataaataactcgataagataactttaaattttgttcatctgcaataattccaattcttcatcggataatattcgctcataactcaattctttttcctcaaaatacttttcccattttgaaacattctcaatatcttttccgataatataaccttctgtcattgcattcatgatttttttatacatatctgtatcatttatcgaatacataatatgccaactttttgatggatcaacattatccatatagtttaatccattacaggctatcaacataattccattttctgttcttacagcttgccctgcaacttcggcatctgcaaatcccattgccataccatctgtttttacaagattagggtatttttctttatacagatttgctaactcctgcagcttttctttttgttcttgattacaaattaagttccaagaaccagcaccttcattccctttaacttttaaactctcaatacctgtaaacttattgatatcaattacataattttcatttaaggatgttgtcggtatactgtctgtgtttaggaactgtttcagggctcccacaagctcattgtcggcatacataacattctctggttcgccaaatacattttggaacacaatataatttttatttgtgttagtatctgtttgcagcgttgttgtatcaggattcaatacaaacgtttggttgagtgttttatcatatatctgccaatatcctgctatttcactggtactttctatggaatatctttctgtatctactcttttatcaagattctcagatacggttgccagatttcctacactaaattttgtacctgaacttttcataattgaatatgcatcatggattgaaaaccctctttgtactttctcctgagcaggactatttaaagaagtttctgtttcattagacataattgaaaaatatcctttattttttctctgtgacatttccatttttctatatagactttgcatacaatttatctgaagttccatacttgtcatctccctatatatagtttcatatattagtaatgagtgatttctacttttttaataattgataacaattatatttttaatatattggttatcaattattgtatcagttatttttactttttcaactataatttacattttttaatttaatgtgtaactctgggatatttcatattggatacttcctataacaattctgtgtggagctggcagtatccacgcttacacattcattacaggcttgatttgttttgtggcagatgtgatttatatttattttctggttcagctgaaacaaaaaggacagaacatatttgtatgatccatataaaaaactgcagctttgacgaaataaagtcaaggctgcagtttttttgtctattctattgtttagtcttccaccagcgtttccatctctttgatgatctcaccgaatgcgtttaatgcatcctggatcggagccggtgtttccagattgacacctgcaatcttaagcagttcgaccggagccatagaacagccaccggataagaactttttataacgttctactgccggagctccctcttccaaaatcttatgcgccacagaaaatgctgcacaatagcttgtcgcatactgataaacatagaagttgtaataaaaatgtgggattcttgcccattcatatgcaatctgttcatcagaaataatgtctgatccgtaatattttttgttgagttccagatatacgctgctcagattatctgcggtcaggctctctccgtcctcatacattttattggtgagcatttcatattccgcaaactgtgtctgacggtaaacagttcccttaaagctgtcaagataatggttcaaaagatatgcacgctcttttttgtctgttgtatttttcaacagatattccatcagaagaatctcattgcaggtagaggcaacctctgccacaaaaattttatatccggcataaatataaggctgtgcctcgttggaataattcgaatgcattgcatgtcccatctcatgtgccagtgtaaacatatcatccagcgtaccgttgtaattcaacaatacataaggatgacagccatatgctccggcagaatatgcaccgcttctctttccctgattctcatagacatcgatccagcggttttcaaaaccttcttttactttattgacatagtcctcgcccaacggtgcaagtgcctttaatacggtttcttttgcttcttcaaaagaaatcttctttgcaacatccgcgatcatcggtgtataaatgtcatacatatgaagttccccgaccccgaggcactttttacgcagggaaacatactggtgcattttgtcaaggttcctgttcaccgtgtcgatcagattgtgataaacactggaagaaacattgtttgcatcaactgcgcactccagagaggacgtatattttcttgcttttgcatgaaatacctgctgctttacattaccgcagtaaaggcttgccgatgtattcagaaactgtttgtaggtctgatataaattctcgaatgcatctttgcgcacacgtctgtctgcagactgtaaaaactgtccgtaacgaccgtgtgtaatgcggactttctctccgctttcatcctcaatctccgggaatacgaggtctgcattgtttaaaatggaaaacgtatctgccggtgtctggctcatctctgctgtcattgcaagcagtttttccatctctgctgagagacagtgttctttcattctgcggatttccgcaatctgctttctgtaaagttccagcgctggcaattctttgtaaaatgcttctaacgtctcatccgtcgctgcaatgatctcagggtctacaaacgcagttttgcttcccattgccgcataaagggaatatacttttgcggacatcgcctgatgtgtggtgttggtctgatcctcgtcaaaaagacgttctgcatagttgaacgccttctcgattttttctcctgcacttgccagatgctctaaaacagccaggagattttcagcggtcgcagcaacgcttccttcatacgaagcaattttatctacgatctctgtgatgacttttaattcattttcccacgcttcggtggtcggatacatgtcttttacattccatgtatccgcctcttttacttcacttctttttaataactctgatgccatgatttttattagtcctcgtaaccatttggattatttttctgccatctccacgaatctgcacacatatcttcgataccgtactgtgcttcccagccaagctcctcttttgctttggtcggatcacagtagcaggttgcgatatcgcccggacgtcttggttttatgacataaggaattttcactccggttgctttctcgaagtttttcacgatatccaatacactataaccgtgtcctgtaccgaggttatagatgcaaagtcctgcattctcctgaattttctttaaagcttttacatgaccgatggcaaggtcaactacgtggatgtaatctctcacacctgttccgtccggtgtatcgtaatcgttaccgaacacgccgagttctttcagtttgccgactgcaacctgtgttacatatggcattaagttgtttggaataccatttggattttctcccattgtaccgctcttatgtgctccgatcggattgaaataacggagtaaaatgacattccattccggatccgctttctggatatctgttaaaatctgctctaacatagattttgtccagccgtatggattggtgcactgtcccttagggcagttctctgtgatcgggatctctgccggatcaccgtataccgttgcagaggatgagaaaataatgtttttgcagttatgctgtctcatcacatcaaccaatgtcaaagtacctgcaatattgttattgtaatattcccaaggttttgcaacagactcgccgactgccttcagaccagcgaagttgatgcagctgtcaatctgctcgttttcgaaaatcttatttaagatatctctgtctaaaatatctcctttataaaattttacgtcttttcctgtgatcgcttttactctgtctaaagatttctcagatgagttgcttaagttatctaatacgactacgtcatatcctgcattctgtaattctacacatgtgtggcttccgatatatccggcgcctcctgtaactaaaattgccataataatcctccttgttttgcgaagcaaaatccaatttcactttgtgaaatttctcctctgaacgaggagaggatttagcctccttgttttttctccgtgttttgcgaagcttcattaacctttcctatggatacatattaacgcacccggcagaaattgtatagactaaaatgtgtaaattatatgtaaaaatgttgcatgttcatttcatgctttatataatacatataaatacaacatcttatgatacagaaaatatctttttattttatgaataaatatttacgattgtcataattttcatcttactgcagggaggtaatcttttttatgaatcaaaattataaaaattcctacaaagtgaccgaaaaagaacttgtatcgctgtccgtctacaatgtaggattccaaaaatgcgatccgctctatcagtggggacccggaatccgcgatcattatctgattcattatatcatttccggaaagggatattataaaatcaaaaatacaactttcacgctgcaggcaggagattcttttctcgtctatccgaacacggaagtactgtattttgcggatgaatccgatccgtgggaatatgcatgggtaggatttaccggaagtgacgcttccatgatcttaaaagcgacagatttttcaacagaaagacctgttatcgagcacacaccactgggcggatccattcacaggcagattctccatatttatgacgccagaggaaatgagtttgaacacgctgtagagatgaccggacgcctctatacaatgcttgcactcttcatgcatggagcaacgacaaacacgacacaaaactctgctaacagctatgtacaaaaggggattgaatatatttcttccaattattcttaccatatcacagtggaggatatttccgcctatgtaggactgagccgaagccagttgttccgttcctttgaatcggttcttggacagtcacctaaggaatatcttacggattttcgtatgaaacaggcgtgctatctgctggaacactcggatctctctgttacggcgattgcaaattcaattgggtttgataatggactttatttttcgaaaacctttcataagatgaaagagatgtcgccgtcggagtttcggaatctgcataagcaggatatttcatagataacatctattataatattataatttatgatatacttttggctaagggaactgaaggggcgaggtacttaccgccggatacttaaaggaggttggtgccaatggttacatacagtgatcttttcactttcgtaattatgctttgtgctgttattactcttgttgtcacaattttacgacacaaaaaataacgcccccagtctggtaaactaaggcgttatctttttaactcatatttaccgacggctaggtgccactagctttcggttctcttgctaaaaattattatatgctatatttataaatttgtcaattttgaatacactgccagtatcttcattttttattgatattctgtactgttgatgttacatttctattagaaagattttgaatctcgtttaagatctgcgtagtggcaggactgagtaattcagaatcttttatttgatttttataaagaaaaacctcgaaaacataacgtttccgaggtttttaaatttctattaagcaactgctttcttagcaacttctgcaagtgctgcaaatccggctgcatcgttaactgccatctctgctaacattttacggttgatatcgataccggaaacttttaatccgtgcatcatctggctgtaagagattccgttcattcttgctgctgcgttgatacgagcgatccataactgacggaactgtctctttctttcttttctaccagcataagaacttgttaaggctctcataactgactgttttgctactctatactgtttagatctagcgcctctgtaaccttttgctaattttaaagttctattatgtctttttttagcgcctaaaccgccttttactcttgccattttttattcctccttacatgattcctatgcgtatggtaaaatcttcttcatattcttaacgtttgttgcatcaaccattgctggttttctaagatttctcttattttttgttgttttctttgttaagatatgtctcttataagctttacttctttttaattttcctgttcctgtaactttgaaacgttttgcagctgctctgcttgttttcatttttggcatgatagattcctccttaaaataattatttcttttctgccaacaccatgctgatgcttcttccttcaacctttggtgctttttccactactgctgtgtcagataagctttctgcgaaatcgtcgagaatgtgtttgcttgcattcatatgagccatttcacgtccgcggaatctcaaagtgatcttcactttatctcccttggataaaaacttctttgcagcgttcattttggtattcagatcatttaaatcaatattcggtgacaagcgaatctctttcagctcaaccactttctgtttctttttggcttctttttcttttcttgccagttcataacgatacttaccgtaatcgataatcttgcagacaggtggttttgcagttggagcgattttaactaagtcaagttctgcttcctcagcaagcttcatagcttctctcgctgacataatgccaagctgttctccgttttctccgatcagacgaatttccttgtctctgatctgttcattaatcattaactcgctaatggtattgcacctccaaaataatttttcatgcttccacataaaaaaagtggataggcagactatccacaatcaatcaaatacgcatatgcgatgtttgaggtattaaaccatgagacactgtaaatttgtgctccggtgagagtggatactctactttgttttcaacaactctgataatataacatacacacactcatttcgtcaagtatattttttgcattttataaattttcttgaatgaaattttataaatttagcatcagtatttgcattttgcgttgccatttagtacactcttcttatattataaaaatttttttaaaatacaagaaccatgaaaggtattgacaaataaactatggatcacagaattatcgatttacacgtacattccaccgaatcagacggaactctcacacccaaagatctggtggctgaggcaaagaaagccgggctggcagcatttgcactgacagaccatgacacctgccagggtgtatgcaaagcaatgccctgcgctgcttctgccggaatcgaactgataccgggcattgaactctccaccgattatcacggaaaagaagtccatatcgtagggttatatattgatatggaaaatgagcagcttctgaaaaagacagccgaataccggatatgccgcagtgagcgcaatgcacttatggtggaggcacttcagaaggaagggctttccattacgatggaagaactggtggctgaaaatccggactgcgttattacacgcgccaacattgcacgtttcctgtatgaacatggccagatcaagagtgtccgcgaagccttcgaccgttatatcggcgatcactgcaaatgctatgtcggcaggttgaaagttgcatccaccgatgccgtgcgtctcatcaaagaagccggtggtactgccattttagctcaccctctgctctacggtctgagtaacaccaatctccagaaaatgatcgacgagctgaaaccggcgggacttgacgggttagaagcaatctactccacctacaccaccggagaagaacagcagatgaaacgtcttgcaagggaaaacggactgcttatcagcggtggctctgatttccacggctcaaacaaaccggatatcgctcttggcaaaggacggggacatctgtatattccttactctgttttagaaacgataaaagccggcagataaaaaaggaagcttacatatcaacggtaagcttctctttttttataaaataaacttctcgatcacttccgcgatcgcatcatggttgttatcattttccgtaacataatcagcggtctttttgatatcatcaatcccattcttcatggcgatgccaatatgcgcggattggatcatcggaatgtcgttctgttcatctccgatcgcaaccgtgctggtatgtggaatatttaacaatttcaccagatactgtgcaccggttcctttgtccgtgttgactggacaatactccagatactctttgcaggagaaaaaggagttgcattttcctttcgcccaggcagcatttgctttctggaaacgttttaatttttcatcatcctccagatggatcagaatgactttctgaggttccgaatccagacaatccgaaattcttcttgtgagtttgtaggtcatatgagaacgctcaacataataatccagttcttttgtgtgtcgttttgtcacaatgtctacagtattgtaggtctgcgcatagatgccggctttatgcgcccggtcaaaaatctcctgcgcaacctcgattggaagtgcacttttataaagcacacggtctgctgcgcagtcatagaccactgccccattaaaggcgatcatatagcatcccggactggtcagtccaagatcctttgcaacaatcctgcccgactctaccggtcttccggttgcaagaacaaaatagtgtccacgctctaacattttctgtattgcagcccggttcttttcagaaatcgacttatcatcacacaataatgtatgatccagatctgcaaataaaattttattattcatagccatcctccctcacacaataactgctctttccgtactgctatttattctacaggttctgccgggataaacactcttccctgatatccgtgagatggttttgaaacattttccattgcctccctgcagaaaacatcctgagatgacaacgcaatttttccgcgtctgtctaccttctcgtaattgccgtcagcatgcagtacatgtgcttttaaagtgtctgccagttccacatccagaatatgtctgacacgttttttcagttcatcatctaataccgggaataaaatctccactcgtctgtctaagttacgcggcatccagtcggcacttcccatgtaaagttcttcttctccatcgttgaagaaatagaatatccggctgtgctctaagaaatttccaacgatcgaacggacttcaatattctcgctcacccctgggattccgacttttaagcagcagattccacggacgatcagctggatcttaacacctgctgcagacgcttcataaagggattcaatgattcccggatcacagagcgaattcatttttgcaatgatctttgcaggttttccctcttttgcatgcttcgtctcacgacggatcagctttgtgaacttcgtgcgaagccagattggtgcaaccgcaagttcattccacgacaatggttcggagtagccggacaacatattgaatacggcagttgcatcctctccgatcgcaccgtcacaggtaaaaataccacagtctgtatataactttgctgtggagtcgttgtagttaccggttccaagatgcacataacgacggataccatcttcctccctccggacaaccagcgctattttgctgtgggttttcagtccaaccagaccatagataacatggcagccagcctgctctaatttttttgcccagacaatgttattttcctcatcaaaccgggcctttaactccactaaaacagaaacctgcttgccgttttcagccgcctgtgccaatgaagcaataattggtgaattgccgctgacacggtaaagtgtctgtttgatggcaagtacatccggatccacagatgcctgacgtataaaatcaaccaccggatcaaacgtctggtatggatgatgcaaaaggatatctccttttcgaatctcatcaaaaatattttcccccggtacgatctccggcacgcgctgtggcgtgtaaggctcattccgcagatcgtcacagccttctaatccatacattttcatcaggaatgtgaaatcaattggtccgttgatctggaaaatatcctgttctgccacttttaattcatcttttaagaagtttaacagctttttgtcaatgccatcctccacttccagacggataacctcgccccactgacgcatttttaactgtttctgaatctcttttagcaggtccgccgcttcatcctcatcaatcgacagatcggcatttcgcataacacggtaaggatatgcgcagagtacatcgtagtttaaaaacagtttatcaatattccgctcaatgacctgctccaataaaatgaaggtcttttcatttccatcttccgaagggatatgtaccaggcgtggcaacacgcttggaacctgaacggttgcaaattcaatttcctctttttctgcttttccttttttcttggaaagaagtgctgcaatgttcaatgtcttgttccgaatcagtggaaatggtcttgaggcatccaccgccatcggggtgagtaccggatatacattgtcttcgaaatatcgatccacaaacgcagcctgtgactcactcagatcttcaaacgcatccatcacaacaattccatgctggtgcataagtggcacaagagaacggttataggtattgtactgaagtgtgacaagctctctcgtgcgctcattgatcttctctaactgttcggatgccgtcattccggcaatatcttttttcttataattggcgtgtaccatatccttcagggatgcgacacgcaccatgaaaaattcgtccagattggacgaagtgatactgacaaactttaatcgttccagaagcggaatggatttatctctcgcctcgtttaatacacggtgattaaatttcagccagctcaattccctgttttcataatattccggttttttaaaatcctgttctttctccataagataaacctagcctttccattggttgtctgtcagccgtagactctcttttctttgatcaccggctttatactgaatacattttcaaagtatgccgttttggcatcaaacagtgctttttccaaagcaatatcatccattgtctcaattgtgatcacaagctctcttcccttgaccgccgccttcacattcttaaacttctgcttgtggctccggtccattgcattggatacacgaaggattgcagaaagttttgcaacggtcagataactgtcatgatccaatttatctgcgagatcttcatagtcaggaagcggccatgtattatataatactgtgtttgcaatgatctcacgctctttgtgtgtcagtccgatgatctcggaagccataataatatcataggagcaggacggaccgttggcaaaactgatatattttccgcagtcatgtaaaatggcagccacctgcaaaagcagccgttctcttctgccaagtccatgtacttttttcatcgtatcaaaaataagggttgccatctgcgtcagtgcatcaatatgtggggtgtaactcatgtaacgctcggaaagatttcttgcggcagataagacatccgcctcaaaatcatgttccacccggatcatattattcttctgtgcatagtggaatgcgataccatcgctgacattcgttcccggtgcccagagactctctgcgccgatgctctctgccatgcatttaaagatcatcatatatggaatgacaagcgcatcactctcattcgaaaggttcaattcctctgagatttcctctaatgtcttctcatccagctttctgatgtactttaagaactttgctgcctctatggtattgtcttccttgtttttttctacttttctgctgatctctgatatataatcaccgatgatgatcaggtatttgatcttcgtctcctgaagatacatagctttaaaaacttcaagttccttgtcaacaagttcttctacctgaagttcatactgtgccagattgttactttttcttgcaagctgctcccgcatacgcatggtgccgagtgccagatgctgtgttgtgactacttttccctttgagaataccgtgatctgcataccgccgcctccggcatccacaactgctgcacctttctggatcatacgctcaaaatcttcccgcatggcaaccgatttataactgataaagcgatgctcagagttacttaaaacttttacgagaagtcctgtccggatgcggatctggtctaagataaaaagctcattttcagcgtttctcaaggctgcggcagcatatgcttcgtagctgtccacccggtagccgtccatgatctttttgtactcggcaagcgtatcacacagcgcctccacaagttcatatccgatacttcccttggaatatgcatctcttccgagctcgatcctgctccggatataatcgatgtcacggattttcttctttcctgaaatctcaaatattttaatacttacttcataagaaccgatataaattgctgcgaatgtatggatcaccagatgtctgcctcctcatttcttttgtatatctctattataccaattttttattcttttccaagtaaatagttgataaattgctgcgctgtcctgccggataatccgccgtgggaaagctcccatttattggcctcagcaagcaaagtgtcctcatccatggaaacctgatatttttctgcaagtactttgacaatattctggaattccttcttattcggtgcgccaaagtagatggaaacaccaaatcttgcatacagggataatttttcctgtacagtatcggaagtatgcatatcctcacgcacttcctctttatccgaaaatgtttcacggatcaggtggcgtctgttggaggttgcatagatcagtacgttgtccggttttttctcaagaccgccctcgatcactgccttcagatatttatattcgatctcaaactcttcaaaagagagatcgtccatgtaaataatgaacttgtaattgcggtttttgatctgtgcgatgacatcattcagatcacagaactggtgcttgtacacttcgatcagacgtaagcctctgtcatagtactggtttgcaatggctttgatactggtggattttccggttccggcatccccatataacaggcagttatttgcctgctttccgttgacaaatgcttccgtattgtcgatgagtttctgttttgcaagctcatagccgaccagatcgtctaatttcacatgggcaatatttgtgatcggcacgatctccacctcttccttttccctgtgctgaatgcggaatgccttgtgaagtcctagtttgccaacgccaaaatctttataaaatgccgtcactgcatctttaaatccggacacatctgtggaagcttccagctttaacttcaactcattgatgcgctccttgatcctcttattaaaaatctttccgctccctgtcatgctctgataatcagtgatggcatccatacagtccatctcaaaataagaggcaagttttccaaaatcaaaatcaaacagcgatttgatgatctcaaagtcatgcaatacgatctgattgacagagccctccacttttccgcggatctcacaagttttgctgtaagcattctcattatttacaagaagaaatgccagaaaactgtgccacagattcccctcaaagccatgactcactgccagttccattaactggttcaaactctcatacaatagagactccacatcctctttattataatattcattttcataattctccatgatccaggtcatgttataaaataattttccattttcaaaatctttatataaaatcagattctttggacttttcatcagtttattcattcccttctgcactcacataattgccaagtattttcaaacggatcgtctcctctgtcagcccccgcagcgcattctgtacggctgcatcattgaggtttccctcaatgtcaacaaagaagcggtactcccacgcttttccctgcaccggtctggactcgatcttattcatgttgattccgttgtagataaaatgggacagcttatggtacagcgaaccgctctcatgcggaacttcaaaagagatactgatcttattggctctcgattcaaaaatcttcttgtttgccacaatgataaactttgtataattatttttattgttctggattgcctcatccagcactttcaaaccgtaaatatccgcagtcagggtgcttgcgatcgctgccttgttcttttttccatcttctttgatcttctgggcggacatcgcagtatttttcagactgtgcttttcccagtctctgtggctctcaaggtatttcgagcactgcatcagcgcctgtgggtgggaataaatgtcggtgatatcgtccatgtctgcttccggcaggcccaaaagtgcatggtcgatacggatgatctgctcgcccacgatataattattgtattccaccataagatcatagttctcggaaacgattccggcagatgaattctcaattgggaatacagcgtaatcggcctctccgttttggatggcttccatcgcatcccgccacgtatctacatgataactgtctgcattctccccgaaatactcattcagcgcaagctgtgaatatgcgccttccgttccctgaaatacgattttagcatttttgtaattcagatgatctacttctttaaaatcggttttttccgtctgaccatgttctgtcagtagctgatactgacgcttccggctcatggacatgatctgctcgaacagttcacggataccatgttttaaaaatggcgtagttccttttctgctcaatgtttccaacttggaaacctcacgctgcttgtcaaatactttctttcccacagcaattttatattcagcaacttcctctgaaattgccattctgcgttcatacagatccacgatctgactgtcgatctgatcaatctcatctcttagttccaataaatctctcataaaaaatccaagcctttccatttattatttataatatattacattcacagtttgcttgcaagagaacacttgcgtcatggtatacagaaatgctatactttttatagataaagattataaatcaaagaggtgatttacttatgaaaaaaatttggaaatggctgctttttgtgttggtgatccttcttgctgccgggtgtgttttcctctaccggtacataaaccgcattcggtataatgacggttatgtcaacggcaacactgcgggaaatctgtataacgaaggatatttctgtgaaaaagatggtattgtctactttgccaaccctgccgacaactactgtctgtactccatgaacccggacggcacaaacatcaaaaagttagaggatcagagtgtcagctacatcaacgtggatgaccactacatttattactgtaaacttaagggaaaaagcgctgattcgttttccttcctcccggtcaataccaacagcttatgccggctggacattgacggaaaaggaaaacctgaaattttagatgatgatccgtgtatgtatgcttccctggttggaaattatctgtactatctgcattatgataccactgatgcaaccacgctgtacaaagtcaaaattgatggcaaggaaaaagagcaggtagaaaaacagtcctactttaccgcaagtaccgatggacaatatatttattataacggactgacagacaatcataatatctatgagatggacacttccaatgaccacgcaaaagtcatctatgaggggaactgctggatgccggtgaaagacggaaacaatctttattttatggactgtgaaaacgattaccgcattgccaaagtcgatctgacaaatggtgaaaaaacgctggtcacggactgccgtgtcgactgctataatgtcacaggcgataaaatcttttttcagaaaaatgataagacaaatccggccatctgttgtattaatacagatggaagcaattatcaggaattaaaagaaggcaactacactgccattaatgtaacttccacttatgtctattttaaagattttacgaccaaaaccccttattatacatctgttgctgccccgggcaatgtacagattttcaatccgtaagcaggcgttgttacaatgcaattttttacaaaaaaagaaacgtcaggaaacttcattttttcctggcgtttctttatcccgcaaaacaaatatttatgcaaaatcaaataacgacaactgattggactccggcatatcgcccagcagtccaagatctgccataagatcaatggtagatttcgtcaccttggttctctggcggaaatcatctttggataagaattttccgtcttttgctgcctccgcaaccgcaattgcagcattgtcacccataccttcaatggtatttaacgccggcataagctttccgtcgatgatctggaaacggtccggcaatgcacggtaaatatcaattggcgtaaaatcaaaacctctcgcatacatctcctgcacgatccgcatatcacggtagacatcctgctcttttttggaaagagagtcttttcttcttgtgtaatccttataaaaatattccagacgctcttttccctgacacatgatctcatagttgaaaccggtcgcacgaatggaaaaatatgctgcataataggcgagtggataaaaaactttacagtatgcaatacgccacgccatcataacgtaggcagccgcatgtgctttcgggaacatatacttgatctttaaacacgaatcaatataccattccggtacattatgtgcccgcatctcttccttccattcttcctttaatcccttaccttttcgaacagactccataatggtaaaggactgctcactgtcaagtcccatactgatcagataaatcataatatcatcacgggtacagattgcagtagaaatcgttgcaatcccctgctcaattaaagtctgtgcatttcccaaccacacatccgtaccatgcgaaagtcctgaaattcggatcagatccgaaaattcggtcggtttcgcatcaataaccatctgcatcgcaaaatctgttccaaactccgggattcctaaacatcccaggggaataccgttgatgtcttccggttctactcccaatgcagaggtattcataaacagcgacatgactgtctgatcgtccaaagggatcgtctgtggatcaagtcctgtcaagtcctgtaacatacggatcatggtcggatcatcgtgtccgagaatgtccagttttaataagttatggtcgatggaatggtaatcaaaatgagtcgtaaccgttgcagtcgtcatatcgtttgccggatgctgtaccggagtaaacgtattaatctcctcgcccaccggaagaacaacgatacctcccggatgctgtccggtcgttctccggacgccgacacatccctgtacaatacggtcaatctcacagtttctcttgtgaattccacgctcttcataataatttttgatatatccaaatgcagtcttatccgcaagtgtaccaatcgttccggcacggaatgtctgtccgtaaccgaaaataacctcacagtaagcatgggctttactctgatactcaccggaaaagtttaagtcgatatccggctctttatttcccttgaatccaaggaaggtctcaaatggaatatcaaatccatcttttaccagctttttgccacacaccggacaaatcttatccggcatatcacaaccacttcttccggaaaatgccttgacttccggtgaatcaaaatcgctgtatttgcaatattcgcaacggtaatgcgcctgcaatggatttacctccgtgataccggacatggtcgctgcaaaagaggaacctaccgaaccacgggaacctacaaggtaaccatcctcgttcgacttccatacaagcttctgtgcgataatatacattaccgcatatccattggaaataatcgaatttaattctcggtcaagccgctcctttacgatcggaggcagttcttcaccatacatgctgtgcgccttgttatagcagatatcacggagcatctgatccgaattctcgataaacggcggacacttatccggtcttaccggtgcaatcttctcacacatatccgcaattttgtttggatttgtaatgacgacctcttctgccttggcacttccaagatattcgaattcctttagcatttcttcggttgttcgaagatataacggtgcctgctcgtcagcatccttaaatccctttccggccataataatacggcggtagatttcatcttccgggtcaaggaaatgcacatcgcaggtagccaccacaagcttgttaaattcctcccccagtctgcagatcctgcggttgatatcctgcagctcttccatcgtattcaccggctccttgtcactgcgcaacatgaactcattgtttccaagcggctgtatctccagataatcatagaactttacaagtcttatgatctcttcctgcggtcttccgcccacaatcgcacggtataattctccagcttcacaggcagagcctaaaagaagtccctctctgtatttgacaaattcactttttggcacacgtggtctcttattataatacgtgaggtgtgaaagtgaaaccagacgatacagattgatacgtccgatgtcatttgtcgccagaataattgcatggtaggtcggcattttcatgaccgtttccggggaggtggaaaccatatggttcacatcatcgagattttccataccgcgttcttttaacatctcaataaatttcacaaaaatttctgctgtacaggcagcatcgtcaactgcacgatgatggttttccagtgagacattcaatgcctttgcaacggtatcgagtttaaaacgattcaggttcggcagcagaattctggcaagagccactgtatctatgatcgtaaactctctctctatcccctgatccttgcagtttttcttaataaaactcatatcaaattccgcattgtgggcaaccatgatcgcaccatcgcagaacttcataaattccggcagaatctcctcaatcttcggtgcatcaatgaccatatcatccttaattgaggtcaattcctcgattcggaatggaattggcacttccgggtttacaaatgtcgaaaagcggtctgtaatgacaccaccgactactttcactgcaccgatctcaataatcttattcttatccgggctgaaaccggtcgtctccaagtcgaacaccacaaaggtttcatcgaggctctgtcctttcgaatctgtgataatatccttcaagtcgtccaccagatacgcttccacaccgtagataaccttaaaatcgtcatccggactcaatgcatggtttgcatccgggaatgcctgtacatcgccgtggtcggtgatcgcaatcgccttatgtccccatttcatggcacgctttacgatgtctttacactcggacacaccatccatatcactcatctttgtatgacagtgcaattccacacgcttctccggactggtgtccatacgggtggtcgtaaagtctgcaatcttcttaattccaacgatcgaaccgattgttaattcactgtcaaacttatcgattgtcgtgacacctttgatttttaagaatgccccttttttcagattgccaagaagctcatccctgtcttcatttcttgtaaatattttcaggacaatggaatccgtaaaatctgtgaccgacatgataatgattgtcttttcgttacggatctccctcgtctcaaccgtcatgacctgacagcggatggtaacttcacccatctcacccacgattttctccaatgggatggtttctccatcctcaatatcacgaccgtaaattacatccggattatcggattttttacctccgccaaagccaccaccatcataacgttttttaaactctttccgcggtccgtcgtatggtttttttgcagtatttcctgcaccatttgcagattttgcatcgttttttgcaggttttacggcgtttccaccacctgtagaaccactgtctccagatgttgtagtctgaccggaaactgcacttttttcattggcatctgaagcaactgcaactgtctctccgtcctcatccttcaaattgatattttttaatatgtttttgatttcaaactgaatctgaagatcactgtttttcttgtatttgctctcctttggctcctcaaagtcgaggtcaacaatcaggttcatgccacagcgctcacacacgattttctctaaaaattccacaatttcatgggagcgtgtctgtgcaatgatcgtattttccagcacaagatgcagatgactgtcatccgtaaattccattttggaggcacggagcagattgtattccatcagactgtaggcttttaactcttctaaaatactgtccttatacatatccatcagcgtgcgggcggtatactgctcggagagctgatacttttcgataatacggacattcatccgttttcccttaaatatctgctcctcaatggatttttctaactgcgtaatgttatttttatgtataagatgactgcccaaaagatagacacggatatgatctctctcatgattcatccctaccttggtaacttccatctcagataaaattttcttcatatccccggacacatccagtgtcggaaagacatcaaaaaatagttttgccataattattcattccaatgtaacagttcatagcggagtgcctctaaaagttctgactccggcacttttttgaatacttcgccatgtttgataataagtccttctccgattcccccggcgattccgatatctgcctcttttgcttctcccgggccattaacaacacatcccataacggcaactttaatgtcaagaggaatgtcagcaaccatattttctacctgattggccagctggatcagattgatctgtgttcgtccacaggtaggacaggatactacttccacaccaccctgacggagtccaagtgtttttaaaattaatttggcagatttgatctcctctaatggatctcctgtcagggaaacccggatcgtgtcaccgattccctgatgtaagatcaatccaagtccgatggctgacttgatattaccgctgatgatcgtaccggcttccgtgatcccgacatgcagtggatgatcggtctggcttgcgatcagttcatgcgctttcacacacatcataacatccgaagatttgatactgatgacaagattatcatatcccatatcttcaatcagttttactttatccaaagcactttctaccagtccctcagccgtcactccatggtatttctccaccagatttttttctaaggaaccactgtttacccctacacggattggaatgttgcgctcttttgcgacatccaccactgcctttacacgctccgcgcttccgatattgccagggttgatgcggattttgtctgctccattctccattgctgcaattgcaagacgatagtcaaaatgaatgtctgcaacgaccggaatctgcacctgtttttttatctcctttaatgccttcgctgcatccatcgtaggcactgcacagcggatgatatcacatccggcagctgtaagctgattgatctgtgcggcagttgcctccacattctcggtttttgtattggtcatagactggatcaaaatcgggttgccgccgccaatgatgcggttgccgatcttcactgtttttgtcatagttcttctccctttcgtataaattcttactggataattgcgaaactttttctaatctatataaacaacttacgaatgtcgttaaacatgatcagtatcatgagtgcaaacaatatcatgataccggcaaaatgtaccatgccctctttttccgggtcaacttttttgccacggatcgcctctaccagcaaaaatacaagtcttccaccgtcgagtgccgggagtggcagaaggttcatgacaccaaggttcgcagaaagcaggatactgatatacagcatttgcaggaatgcatagaagtagccgtaggaaacactctgctcatagctgtctccgattgcactgacaattcctaccggaccactcatatcattgacggtaacgcctccggtaaagagcatctttaagcttccaagtgtcgtatagatccagtactccacctcgtaagcactgtattttgccagcgtgaatacattgtttgttgtcttctctctggctgccattccaataaatccatataaatatcttccggtggtctcatcatattttggagtgagttccgttgtgtaacgttctccatcccgctcataagttactttcaccggttctccggcatggtacatggaatatgcactcacctcacggtaaaaatgaatatgtttatttcccatttttacaatcgtatcacctgcctgaagtcccgcttcctctgcggcataaccctcactcacatctgagagtaccggaagatcatatccggtgcagcagacaagaataaaagagaagataaaggccatgataaaattaaaaattggtcccgcagctacaacgctgatccttgcccagacagatttgttgttaaacgccttgttatcctggctttccgaatcctctccctccatcatgcaggctcctccaaatggaagcagtttgatggagtattttgtctcacctttctggattccgaaaagtgtaggtcctaatccaagtgaaaattcattgacacggattccgtttgcctttgcaagtaaaaaatgtcccagttcatgaaacaggataataatgctgaatatcagtaatgcgataataattttcatgtaaaaaacctttcctgatgtcttgttgcatttttaaatgcgttttattttgcactcatctttttttcaataaactcataagcagctgcttctgtccccaaaatttcatccacatccggatgatcgataaactctgcatcttccatacatgcctcgatcaactctgtgatctccggataagaaatcttccggtctaaaaacagactgaccgctttctcattggcagcattgtacacagtcggaatatttccgcccttttccattgcctgatatgcaagtgcaagcccgcgaaatgtatcggtatccggcttctcgaaggtaagatctgcaatttcaaacagatccagtctcctgcccgaaagattccggcgctccggataataaagtgcatactggattggaagtctcatatccggcgtgccaagctgtgcgatcactgctccatcctgatactctacagcagaatgaatgacactctgcggatgtactacaacctgaatctgatctaaagccacatcaaagagccattttgcttccatcacttccagtcctttatttaccaatgtggaagagtctatcgtgatttttcttcccatgctccagtttggatgtttcagggcatcttccacctgaatattcttaagttcatctgcttttcttccacggaatggtccgccggaagctgtcagtaaaatcctgctgatcttattatccccggcaccctgcagcgactggaaaatcgcactgtgttcgctgtccaccggaagaatcggcaccttgtattcctttgcaagcggaataataatatgtccggcagtgacaagtgtttccttgtttgccaaagcaattttctttcctgctttaattgcagcaatcgttggtctgattccaagcataccaacaattgcggtcactaaaatctcactctccgggatcaccgatacttcaagaagtccttccatgccggacacgatttttatgccgaggtcttttgtattcgtacgaagttctgatgcctttttttcatcccatacactgacaagtgatggcttgaactctctcatctgcgcttctaacaaactgatattacttccggcagccattgcaactacctgaatatccccctgctctcttacaatatcgagtgtctgtgtaccgatagaaccggtagaacctaaaattgcaatttttttcatgttttataatttccttatcttataatttaataaagttcactgcaaggaaataaatgatcggtgcagtaaagatcacactgtcaaaacggtctaaaatgccaccgtgtcccggaatcagttttccgtaatctttgatctcgtaattccgcttgatggcagatgcagtcagatccccaaccatagagatcaacgctccaaccgcactgattcctgccatgatccagacatgtgtctgatcgatctgcatggcatttttaaagatcatgccataaataatcgtaagaagcgctgcacctacaacaccgccgacagcgccctccactgatttcttcggacttaatttgggcgacattttatgtttcccaatcaacattcctacacagtatgcacaggtgtcgcatccccaggaacacagaaaaacaagccatacaatgtaggcacctgcctcaatcatacgtgtctgatacacatacgacaacatcacagcaacatagaacacgccaaaaaatgctgcaagtacctgttccgtcttatacttcggatatgtaaatacatatgcgaacatcataagaatcaaaacacctaatacaaacaccattgtatccggcaaaaatgcaaatttcagattacaataatacacggtcgctgccagataaccaatgattccaaccgcctctttttcaatgtgaaaaatgcgatataattcaaacataccaatataggaaataaccagtgttgagatcagcagaacatctccgcctgtaatgatcagcaccagtgctgcgatcactaacacgattccacttaataatcttgtcttaaacattatttttctccatcctcctctgagagtgcgccaaacctgcggtcacgtttattatatgcttcaactgccttttctaattcttctttatggaagtccggccatggaacttccgtaaaataaaattcactgtaagccagctgccataagagataattcgataagcgctgttccccactggtgcggatcaacagatccggatccggaatatctttcgtatccagataagcttcaaaatgtgtctcatcaatctcgttttcctgcaatttgccgtcacggagatctgcatacattttccgcatgccccggagcatctcatcccggcttccataattgatcgcaatctgcagattcaaaccatcattgtgtgcagatgcagactccaattctttgatctgattttgaaacttctcactgagttttgtggtatctccgatcacccggacacgcatattattcttatccgcagttttaatacagtttttcagataagattccagtaatttcatcaatgcatttacttcgttatccggccggttccagttctcggtagaaaaagcatataaggtcagatatttaattcccatatcatgggctgcctgacagactgtctccacattcttagccccgaccgtatgtccgtaatttcttggcattcctttgctttttgcccatcttccatttccatctaatataattgctacatgttgtggaatcttcatgctctttgtatatcctttctgttccagtcaaacggcacaaaactttgtaatttttttgttccgctgtcattgcaaaatattgttcttttataagttacgaaaatgaggacacgattttctcatgcccccactctttcttttattctgtcaatttatttatacagttaaaatttcttttgttttaacttctactgcttcatcgacagctgcaatatatttatctgtcatcttctgagcattttcttccaatgctttgatttcatcttctgaaacatcctcttttgcaagtttcttgaaggaatcatttgcatcacgacgaatattacgaatggctacttttgcactctcacctttcttctttacgtcttttgcaagatctttacgtctttcctctgtcagttctgggaataaaagacggattgtctttccatcattggtaggattgattccaagatcagatgtcatgatcactttctcaatctcttttaccatagaagcttcccatggctgaatctgaatcattctaggttccggaacatttacgtttgccacctgctggataggtgttggtgttccgtaataatcaactctcaatttatcaagaacatgtggattggcacgtccggcacggatacttccaaattcctctgataaattgttcattgttttctgcattttctcatcgaactgaactaatctctcgtccatattaatcctccttgtttttgcgaagcaaaaatccgaactccgagtgaggagaggatttagcctcctaaactgttacctttgtgccattaaattctccactcatggcctttacaatactattttcttcatttaatccgaacacatacatcggcatcttgttttccatgcacataatggatgcggtaagatctactacagcgagcttctggtcaattacctcctgaatagatacctcatcatacttcttagcagccggattcagcttcggatcgctgtcatagacaccatcaattgcctttgcaagataaataccttctgcttccatctcaattgcgcgtaatacgattcccgtatcggtagaaaaataaggatgacctgttccacctgcaaagaaaacaatctttccctcattgaaacatttatctgcctcatctttagagaaaagctttgtcatgcttccacataaaaatggtgtaaaaatctctgtatccattccaacagaacggaaaatctcagatacatagatacagttcatgatggttgctaacataccgatctgatccgccttaggtctgtcgatcgtctcggaagttcttcctctccagaaattaccaccaccgatcacaataccaatctggattcctttatctgcaatctgctttacctgttttgcaacttctgtaacggttggttcatcaaaaccagtgtgtttttcaccggctaatgcttctccacttaatttcaaaaaaactcgtttcatttatgcatccatttcctttctggattattcattattcttggaagcaaaaaggctctcaacatcaacatctgagtagcactgggagcagaaaccttcgatgactgcaccattgttgatctgtacggaacgggatttgatgttacccataacaacagcggatgtatcgacaacaacaggtccctgaacatcaatatctcctttgattgcccctgcgataactgcagatgaagatgttacattaccaataatcacagagccaagtccgatcttaacagtacctgtgcttacgacttctccctcaatcttagctgcatcagcaaaaaattcagaagaattgctgttacctgttactgtacctgttacaacaagttttccgttacatccaatgtctccctgaacgtttcctctgatgtctaaagatccgttggatacgatatctcctttgataatcgttccctctgtaattacagatacctcatctgatactggttttgtttcattgacaactggtgttatattgtctgccatttttctttcctcctgagtgtttttcacatgattttccgggatcaccggctgttcgatttttgtttcacctgctggctttggctgcggtgcggacggaactggctgattctgcactgaagtctgctgttttgcagtctgtgaagtcacctgctctaaaagaccgtctaatttggaaagttcagattcaacatcaacttcattttccaaagtgttcacaactaaatcttcatttgctgcgccatcttctaaattgtcctcacccggcatcagttcattcactgcctgtgaaaaatcatctttaaaatctttaaaaaatcccataatcttcctccatttatatttagttagtcaatactgtctgccttcacatattgaataactgatgtatcttcatcaatcggcaggatctcagcgcccatttcattcaatgcctcgatcaatggtgctaaagcctctaccgttgctgacttatccgatgcgtcatgtaacaaaacaactgacgttttatattttactacatcatccatcacattcgcaactatttcctcggatgaatatgcattcgatgctgcatctcccgcagaaacgttccagtcataataaataactccctgttcattcaggtaatggataaaatcactcattggtacgttactgatctggttactgcttccacccgggaaacgatagtaaatactgttcactcctgtgacctgatacaattcatcacgtaagcgttcaaaatcttcttcaaatgcctcatctgactgatagatctggctgtatttgttggaataagaatgcatgccgagcgtatgtccctcatctgcgattctctgatacagtgcctgggattcttcatcctctttcccgaccacaaaaaaagttgccttcacatcatattgagccaatatgtccagaatctctccggtatgatcagaaggcccgtcttcgaaagtcaggtaaaccttatgtatatcgccatccccggcaagattctcttcctctgaaatgccggtagccggcggtgtcacagactcataggtttttggtgtctctgttgcttcagtgacatcggtataaacagactccccggcactttccggtttctgcgcattttcctgctgaacctgttccttcgaactgactgtcacaatattatccagtttatgctgaatctttattacctgcacaaataaaacaatgatcagtatcatcgacaggatgatccatccggcaatcgtcattataataccattccgaatccgtccgattctttttcttcgttttctttgattatttattgcctctgtatctttatcctgcatggaataacccccaagcttatcatttgtctcctatctattgtaacacattttttgatttttcaaagcagaaaacagcatataatcgtatgattttttcaaattattgcaattattgtcagaattttcctattttaaaaggggcaagccgtcaaaacagctctgcccctccgcatccaattacaaatctgttactctaatgtaaatttagtaacaatatctctcagctcatctacacactgataacattcttttactttatctgttgcggatgatgtcttctctaccatgccggaagttttttctgcaatatccgtaacgcccacagaggattcacccaccgtatcgttgatgccgctcaaagcacttgcgatctgctcgatcgcacctgcaagctgcgccatggatgtcttgattccctccatgctgctcttaaatacattcgcatcatccttgtactgttcgcttacctgttcaaattccttgtaatcagcagatacgctcttctcaaggaactctgttgtctcttccagacattccgacatattgccgactgcctcgtttacttcttttacaatcgcactgatattggcaattgcctgggaagtctggtctgcaaggcttccaatttcagttgcaactacagcaaatccttttcctgcttctcctgctcttgccgcctcgatggatgcgttcaaagccagaagacctgtctgggaagaaatctccatgatagttcctgtcagttcattgatcttctcaactgctttggagccttcaattgctttttcagctttctccttgacagaattataaatctccattgtcttattgcttgcggtgacagtcttggtacgaagctgtaaagcacgatccataacagtttctgaattctttgcaccttcctctgccatggtattgatagtttcagcttctcccttgatctgggacacattctcattgatcgtgacagttgtcgctgctgtctcctgcataccggcagcaagctgctggctggttgccgagttatcggaacacatctggttcaccgtatccgtaacctcatttaactcagacacattctcattgatcttctgtcctgcatcctggatactggcaaccatatcacgcagatttttgcgcataatatgcatttcagctgccataatcccaatctcatcttttctgctgtataatcttctgctgttagcattatgggtaaagtcaaaattagctgttctcgtaataatataagtcagctggtgaattggttttgtgatcatgtttgtcaaaaccaatgcagccagacagcagatgatcagacagacacccatagtaatctgcattaaccttaccatattggtgatcggttccatgatctcacctttatctgcagacatcacaacaatcttgtggtcagatgtcagtgcatatgcagcatatttgactgttccgttaaaattataggttacaaccgcatcctgtgggatattgcctgattgcagctggctcacaacgccctttacaacctcattttccacagattttccaattttatctgcagtcggatgataaagcatcgtgccgtcagaatctacaagatatccataggcagacgacacaccctccatgcgcatatcctgcatgacagctgcacactgggtggaaaaatctacctctgccggaatcttgtccaatgtttttgccgctgattccgtaaggctcaaaataaatttctcgttgacattgctgactgtcgccgaagcccttacatttgcgattgaaatacacgccataagcgataaagccaccatcacaaccaccattagcatgatcttcgctgcgatggagtggataaatgatactttttcttttgtttccatgactataacactccttcttattttctggtctgtgtaacatcagcactacgtttgtaatagttatgttaacttttctattaataccatgataagatactttccaatatttagcaaggttttttcaacaatattttacagccatttttataaattaccgacaaaaaatgccctgaaaacataatcgtcctcagggcatttcaaaatcagattttattatgcgttcatctgtgctgcaacttcagctgcaaagtcttcctgtttcttttcgattccttcaccagtctcgaaacgaacaaatctcttaacgcttacaggtgtaccaactgctttggaaacttcgtctaaatatttagcaacagtctgttttccatcttcagcttttacataaacctgatctactaagcagatttcttttaattctttgcttacacgtccttcgatcataccattgatcactttctccggtttctgggactcttttggatcgttcatgatctgagctaagagaatctctttctcatgtgcgatatattcttcgctgatctcatctctggaaacatattttggatttaaagctgcaatctgcattgcaaggtttgttaaagcttcttttacagcatcgtttacaactgctgtttcagcctcaacgataacaccgattctaccgccaccgtgtacgtaagatacaacacatccgtttgtagcaacaactttctcaaatctacggattttaaggttctcaccgatcactgcaactttctctactaaagcatcttttacagtcttagatggatcctcattccatttttcttccatgaatgcatccatatcagctgcatcagactcaacagcctgctctgcaacagcttttacgaactgctggaatgtctcgtttttagcaacaaagtctgtctcagagttaacttcgacaacagctgctgtcttgtcatcttttacaactactgtacaaagaccttctgcagcaattctgcttgctttcttctcagcttttgcctgtccattttttcttaagtactcaacagcctcgtccatatttccgtctgtctcgcctaaagcttttttacaatccatcattcctgcgcctgttaattcacgcagttcttttaccatagctgctgtaatagccattttcgtatcctccaatatgaataaatgtttttaaaaaatatgctgtctggttaaccagacagcatattgtaggtccttcttatgcttctgcttcttctgcaacagcagcttcttcagctacttcttctaaagcttctgcaccctgatttgcttcaataacagcgtctgccattttagaaacgattaattttacggctctgatagcatcatcgttaccaggaattacataatctaattcttctggatcgcagtttgtatcagcaataccgatcagtgtaattcctaatgtatgagcttcctgaacacagattctctctttcttaggatctacgataaagatagcatctgggattttcttcatttccttgataccaccaaggtttttctctaatttctcccattctttcttaagagcgataacttctttcttaggtaatacttcgaaagtaccatcagctgccattgtctcaatctcttttaatcttgcgatacggctctggatagtcttgaagtttgttaacataccacctaaccatctctcgtttacatagaacattccacaacgctctgcttcagatttgatagcatcctgagcctgtttctttgttcctacgaaaaggattgtaccaccttcagcagcgatatcagacatagctttgtaagcttcatctactttacctacagatttctgtaagtcgatgatatagataccatttctctctgtgtagatgtatggagccattttaggattccatcttcttgtctgatgtccgaaatgaacacctgcttctaataactgtttcattgaaataacactcatttttttacctccatggttttgttttcttccatgtgtatcattcttgcagacaaccaaatctggcaccggtctgtaagtcagcacatgtgatttttcccggaagattcttttcttccaagttgagccttgtagattatagcacaggcttttcctgtatgcaagcatttttttctattgaggaccaagttttaaaatctgatagatttcctcataatctaatccataaggaatggagtaacttcccacactgatggaagatgcaaagcccttctgtccaaggaacttgcggaatgcctccgcatcgtccacaactccgtttgcctgaagattttcacagacaattctgcacacatctcctctgtttacaaccaatgtatacggcgctgcattcacggctgtgttgttttcctcatttgcctctgatgatacttctgttgccacttctgtatctgtcatctctgattccggattctctgtttcatctgcagtcaccggttcttctgtatttgcagcagcctctgtcgtctgttcctcaatttgtgcagcttccgtttcaggaactgctgtcacttccgtgctctctgttgtctcagtgtcctgcaacggttcttcatcctccggcataaccattccaagctgttttgctcttgcaatgatatccgcatctgacattgtaggtttatgcagtgcaaatgcaatcatcagaagaatcgttgtgacaataattccaatgccaagacctcttaaataatattttaatttcacagattttcgtcccctttatacaattcgatcactaaattcacttcgccaaggccacgtcccaattgttttgcaatctcgactttgctcagtccctgttcataaagttttaaaatcatatcatttgacatgccctgtgcatccgctgtttccggtttttccgttttctgttcaggttcctgaatttcttggaaacgattcacctgaacttcaggttccggctgcacatctatcgtctctgtcatcggttgtacaactgcattctgcttcattacaggttgttgcacaacatgggattctgcaactggtttcctgattgaagtgcctgctttcgcggacagattttcctgtaaatttcggatatctgcagccagacgctgtaaatctcctgtcatagatgtcatctcggtatgtttgtcatttaacatactgtaaagaaacatgatctcatcatgtgttttcttcatggattccataaccgtttcagagtactcatgaatctgcatgatctgttcattagactctttctccatggcacgctctgcctgttcacccgcttcttcgattttctgttcgatcacttcatccatctgtgtaccggcattattcacttcacgttcaataatcttttttaattcatcttcacttaattctgcgatcttattcaactctgaagaagataatttttcgctgatgaaaaaacttccaatcataaaaacacatccaaccagaagtaagataatttcaatcatcgtcatgtttctgctccttataccttgatatcaaatccggaagtctgtcccttcaaataaacattgtcagccttttgctgcttcttgtcttttttcttccgttcttccttttcataatgcccatttcccttttctttggcatcataacgataaccggcattctctttttcccgggcatgaaccacctgatggagattctgctccacttttttcatttcctgtgaaaaaatcgtctgctgttccaccacaggtctgttgtcttcattctgttttaaagtactcacgtcctgcgtgcgttgtatcattccgttaaaatcaactggtctgatggacataatgatcacctctactctctgtctatgagaattccaagataatttccaagctttttgcgcattttcaaaagagccttcgtatgaagctgggaaattctcgattccgatacttcaagaatgctgctgatctcctttaatgtcagatcttcataataatataaaagaattaccttacgttccttctctgtcaggacttcaagggattcttccagtttctgtttcagttcttcttcctcaaccttatcttccggctggataaaatgggaatttctccgtgcatccatgaccggttccgcaccctgctcaagatactcgtttaaggagacgacattcgtgactttaagctgcgactgccatgtggtaagttcgtcttctgagagtcctaattcctgcgcgatctcctcgtcagaagcattttttccggtacgcatttcaacctgtttgatcgcctcatcgatttttttctgtttctgtctgacggttcttggaatccagtccattttgcggatctgatctaatatcgttccacggatccgcagactcgcatatgtctcaaacttaacctcttttccgagatcaaatttatcgatcgcatcgatcaaaccaaagataccataacttacaagatcatcatattccacattatatccgagatacatgctcaatcttccggcaacaagcttgacaagcggcgaatattctattattagtttttctctcaactccggtgtcttttttttctgatattcttcccagagtttctctctatctaccgttttcatatgaagcccccaggttcaagttattcactcttcttctccccgtccgagtctgactgttcctgtgtctgttcttctccggactcttcctggttttcttcaggttcatccatttctttaaagtttttatcaagaaccagtttcacaatgcatcctaataaataaaaaataattaaaaccgcaagcaatgtcttgataaaaacatccgtttccatatgctgtacaattccaatgatgcatgtgacaaaccctgcaagcagcatcacgactgccggtatgccttttgttttcataatctctccactaaaaacgtttttcacgattttttaaatagttttaattggctttcctactgattttatcagaaattctccggtgtcacaatgtaactcgaccgtgcgtccatagtttaatccggtgtcttcggcaaccagccggattcctttttcttttaaaatcttctttgctgcttctgcatttctcgcaccgatatttccgacatctgataaaccactgacctcaaacatcttcgcaccgccagcaatcttggcaacaagccttgtcttacttgcccctgcagcaatgactttttttaataattcttcaattcctgtatctgcgaattttgccttatttgaattgttgctcacttttgtgctgtccggaagcatataatgaaccatgccgccaatctttgtaaccggatcatagagcgtcagtccgatacaggaaccaagtccaagtgttgtgagtccgtcaggagccttgcatacattcaaatccgccattccaaccttaatgatattccccatacaaactccttacagtgacaacccaagtgctgataatattttgtaataagattcctgttccggcatcagaataaaatagcctctgatcgctacatctgcacagatctctgtctcgatcaataatgcccggtcaccaaccagaccaaactcaatggccggaacacttagaatagcagccgccatatcgacacagatatacggaacagatggtaaaatcgttaaatttgtcatggaagccagtgctgaaaggtaggacgctgtaataatattccccacctctttcaatgctgaaagttccatttcatcaaaaacttccatctgctcatgaaccacattttccttcattaaaagcttatccgcaagataatgtccggattctaaatccagcaggaacatcatgcttccatcaatatcatgcgatacctcaagaaaaataccgatcaccgtctcttcttccggtccgatcgcacttcctaattttcctacgtccatcaattttacatttgggactttcatgtcaatgcgggtgccgaccatatttgcgattgcggtcgctgcgttaccggagccgacatttccgatctccttgagcacgtccacgtacatatcattaacttcatccaacgtatactttgtcatttattttctccatctgtttctgcataataaacacagtgagaccttgtaagaaaggtctcactttatggaattacgcattttctttttcttctacaatcgaactgatctcaaataaagatatcagttcgtccccatgtttgccaacaccattgataaacatggcttttccgtccttgcttccgcttgtcttatcaatctcatcggtgcataaagtaacaacctcttttacttcatctacaatgattccgatcgttcctttttcctcaagctttaaaataatgatcctgctggcatttgtgatgacatcatcatccagattcatttttttacgcacactcataacaggcacgatctccccacgaagattgatgacccctttaaagtatgtctgaatctttggaacacgtgtgattttctgcatacgcacaatattgtcaatatagctgatatcaattccgtactgttcgctgccgatttttacaacaatatactgttttgcatcattttcagcgatatctatatttttctccatattcgtctcctccattacatcaatgtattaacgtcaaggattaatgcaacttcaccatcgccaagaatggttgcgccactgataatcttattgttgttgatatactttccaagagatttgataacgatctcctgctgtccgatcagattatctacaacaagacctgcgaggctgtcgcctttcttaacgataacaaccgtaagattctccggttcttcctgtttttcttccatatccagtacctgatcaagacggatcagtgggataacggcaccacggagatggatcacctcctgagcctgaacatatttgatctcatttaccgggatactttcaatatttgaaatggatccaagtgcgatcgcatatttttcatcacggatctcaaccattaatgcctggatgattgcaagtgtcagcggcagacggacaatgaaagttgttccttctccaagctgtgtgcggacttcaacgtcaccaccaagtgcttcgatgttagattttacaacatcaagaccaacaccacgtccggagatgtcagtaatcttctttgccatagagaaacttggaaggaataagatattgatgatctctttctggctcatattctccgcctgttctgctgtaatgacaccgcgttcaacagctttgtcccttaccgctgcaacatcaataccattaccatcatctcccacttcaatgataacgttattgccttcctgaaaagcttttaggaagatagaaccaacttccggttttcctctctctacacgggttgcattgtcttccagaccatgatctgctgagttacggagtaagtgctgtaacggatcaccgatctgatcgactacagttctgtctaactctgtatcttcaccagtcatatacagctccattttctttcctaacttacgggaaagatcacggatcatacgagggaacttatttacaacgctctcgataggtaccatccggactttcataacagactcatgaagattcgttgtgatacgctctaagtattcaatctgttcatggaacgactgattctgatactcaccactctcgttagagctgatggagaccagactgttctttgcaataataagctctgacacctgattcatcaaagcatccagtttttcaatatctacacggacagttcttccggttaccggttttgcattggtctgtttcttggcatttgcagccggtgccttcttctcagccgcctttggagcttctgcaggtgcttccttctgttccgctgtcgcttcttttgcctgctgttcttcctgtgcttctgcctcttttacatattcatcaagatggatctcttccgcatctactttttcaatctcagaaacagcctttgctactgctacgatcttgtcctcagattcttccgaggcaaggaaaaagctgaactcaaactcaaacttctcgtcttcgatatcctgtgagcttggacggtataccagaatctgtccaaaatcttccacagccttaaatacaaggaatgcacgggctgccttcaaaagacagtctttctggatatgaactgtcatgacgtaaatatgctgtccatttgactccgcttcacggattgccttcttctcgtcatttgtcagttcgattttttcctgtcctgctttttcttcctgagtggattcaggtgctgcttcttttgcttcagaagtctcagtattccctgtttcttccgcaccctctgtttttgcaataaaatcatttaattctttgatgataacttcgttatcttctgttccctcatcggaggtactcttaatattgtcaacataaccttcaagtgcatccagacatttgaacaagagatcgatcatcccacttgtgacttttatgtgatcgctccgcacttcctgaaacacattttccatatcatgtgtcagatgctgcattctcttaaagcccatggtacctgccataccctttaaagagtgtgccgcacggaacacttcattgatcgtatctttattgtccggttctttttcaaggaccatgatacaatcgcttaatgtctgcagatgttcttctgattcatcaataaatatttccagatactggcttacatccatgttaatttacccccacattctttgtgattgaatttgctacttctgtcagcggaacgacttcatttacaagtcccgtctccgcaattgctttcggcatgccatagacaacacatgtcttcgcatcctgtgcaatcgtataaattggttttacttttgataattccaggattccattggttccatcagcacccattcctgtaagcacaacgcacactacctgatcatatccacatgtcctcaaagaatcatatgtgatatttgcgcatggtttcaatccgccgatcggtggcatatcgttatatacgatcttatgtgagccatccggacacttctttacttccatgtgttttccgcccggcgcaatgtaaacagttccttttttcaggatttctccattctcggcttcctttacattgatcttactgatctcatccagacggtttgccatggaattcgtaaatccggcaggcatatgctgcacaagaaccattggggcatccagattggccggcagataaggaatgacactctgcaaagcttttggtccaccggtagaacatgcaagtgcaacaattttattcttaaaccttgtttctgccgatgcattgcgtttctgcacagcactgacagctgccactgcaggtctgcgttctgtaaggctgatccgttctgtctttaaaacggcatttaaaatacctaagatttctttccggaacgcatccccttttgcctcaatgatatttgttggttttgtcacaaaatcaactgctccacgctccatcgcaaggatcgtcacatccgcatcccgtgttgtcatggtactgaccatgatcacatttgtcttaatgcgttctttctgcaggcgctctaaaagttccagaccgcccatccttggcatattgacatcaaggatcacgccatcataacggttgaccttcagcttttcgtatgcttccagcccatcgcggcacacatctgttacctgaaatgtatcatcggaattgattatatcacatataacccttctcatgagtgcagaatcatcaacaacaagaatattttttttcataatcattaccttttatccttttgacgtgttaatcgttcctcttcaaaaatatatcggataatatcctctcgtactctgtcgtctttgatcataaacttgacacgggaaacatatttcttttccgttacctgttccttcttctcgcaggaaataacagaaccaacaatatggaattcctgattcattctttcatttgcgagatgtgctaccgcaaggatatgatctccactctttaactccgtatctgaattaaagcggatgcctccaccgctgatgtcaacgatcgtacctgtccgtatcttgtcattaaaatgttcatcgcgcaattgggcaaaaatctcttccactgttgcaagatctgcctgctcttccgtcagttcgaaaaacttaaaatcaatggaacactcatatcggtaaaattccctgcgctggaacttttccagacgtgttttaagttctacttccagtgtataaatattatcccgcttgaagcgctctacgatctgtccgatacttttatataagaatcctccggaataaaaaacaaattccaaacgtacatccagaggaagaagaatcagttttgttccctctgtaggcattgaaatctcaagattgccacgcttatttatatcaagaacctggctcttgtaaactttaaccgtatcgccagtccgctcctcattttcaacctgttgtaataacctgatatcgatcttgtcaccaggctttatcaaatctgtaaatgccatatagctcctctccttatgaaaggttaaataattttgtcagaaattgtctgaaagcattttgttccgaagaatcctgctttccgccagacactaaatactgtgccagttcctcaaaccgttttgaagaccttgcattcggcgacacgatggaaaccggtttttgtatccgcaccgctttctctaacatcgcatcctgtgggatgatcccaatataatggacagagccatccagaaactgttttacaaccgattccagtttgtcaaaaaccatctttccctcaccaaaggaagcaacacggttcgtcagtacatggatcaccgattcattcttatcgtatttcggattgcggtaaagcatcttcaatagcgaatatgcatccgtaagtgagcttggttccggtgtagtcaccagtaaaatctcaggacttgacgccacaaactccatgacactgtctgaaattcctgcgcctgtatcaacgatcacaatatctgcgatcacagaaagcttttccactgactttaccagataactgatctgatccagtgtcagattactcagtcccataataccggagccgccggaaataaagccaaccccctccggtccatccgtaatgatgtcctcgatttctttgtcatgatagatcagatcgttcaggctatactggggaattgttccaaacatcacttccacgtttgcaagtccgatatctgcatcaaaaatgatcgttttcaaccccatccgctgaaactggactgcaagatttacggcaatgttggattttcccacaccgccctttccacttgtgacagtgatgatcctggcgggcttctttgttctctgattctgttttttgatcacattgcgcagttcttctgcctgatccatctgttactttcctccaagcagttgttttaccaccatctgggtattaaatacttccagatcatccggaacgctctgtccatttgtcatataagacagatctgcccctgaatataagcggatatttaatatattgccaaatgaagtggtttcatctaattttgtaaaaataatcttatattctgcaatttccctataaatgtcaacaatctccataagatccttatacttcgttgtagcacttaaaacaaggtaaacttccttttcatattttaggtcaagaccattgaccagtttcttaatatcttcacgctgttcctcattcttatgggaaaaacctgcagtatccacaaatacaaggtcgtattcagccagtgtctccaaagactgattgagttcttccgcagagtaaatgatcttcaccggtgcatctaaaatattggcgtaaatctttaactgttctgccgctgcgatccggtaagtatctgctgtcagcatagcaacctttttgtcatgctccaccttgtactttgctgcgatcttggcgatcgtggttgttttgcctactcctgtaggtcctacaaaaaatataacatgcggcttctttcctgacaagtcaatgcaatttggctctccaagttttaagatcatcttctggtaaacattggaaagaataatatcaacattgcttccgctgtttgtaaccttctcagcttcatcgagaatctgattgacatacttttcatttacatcattgttcagcatggtacggtagagcatcttcataaacttgaaattttcaagattttttggagatgccttaggagtcaccggcatttctgcctcccttgctccatcttcactgagctttttttccaaaatattggaaaggttttccaatttcttttcaatatcactttcgctcttattcaccacaacttctttttctggtgttaccggacgctgataggaaggcgctggctcaacagttttttctgccggaagcggaatactgatcttctcatctgcggcaagattaatattttcaatctttttctgctgcattgctgccatctggacagcatttaaaaactgctccttttcctcgatcgctgcagtgacttcaaaggtagagcccttaaaaaaattaaaaagcccctttggtttgatttcttttacattcatcacaacagctccggctccaagctcctgtcttgccttctctgttgcctcttcctgtgtttttccctggaatttttttattgtcatttatgctgtcaccatccctactgattgtaattcaatattcgattccacttcattgtatgaaacaacgatcagatctttgaaataatcttctgtcagtttcttaaaatacatacggacaatcggtgaagtgataacgatcggagtttttcccatattttcaagctttgcagcctcctgctccaaagatgccataatggccttggtgcgttcagggtctaaggttaaatacgctccctgctctgtctgtttgactgacgacataatctcctgctcgatcttcggatctaaagtgattacactggttgtctcgtttgccgggaagaatttatttgagattgccctcttcagactctggcggacatattctgtcaggacatccgtgtctcttgtcacagcggcatgatctgcaagtgtttcaaaaatagtcaaaagatctcggatggaaattccctcgctcaataaattctgtaatactttctgtacttcaccaagaccaagcaattttggtatgagttcgtccacaagaaccggattgctctctttcagattgttgaccagattctgtacatcctgccttgtcaaaagctccgcaatatggttccggatcacctctgtcaggtgtgtagcaataatggatggcggatcgacaacggtatatccaaggctttccgctctctctctctggctctctgtgatccagatcgcaggcagatggaaggatggctcaaaggtcggaataccagtgatctcttcctctacataccctggattcatcgccatataatggtcaaaaaggatctctccctctgtcacctggatacccttgatcttaataatatactggttcggattcagctggatattatcacgcagacggatgatcggcacaaccgtaccaagttccaaggcgatctgtctacggatcatgacaacacggtcaagaaggtcgccaccctgattgacatctgccaatggaataataccatatccaaactccagttcgatcggatctacctgaagcagtgaaacaacattttccggtttgcgtatctcctctgcctccgtctctgcctcactcacttcctcctcaatgctctccacacggatctgtttatccatcatacgtccggaaatgatgaacacaagaccaagaccgacaaagagataccatgtcaaaggtgtcgtgatccccaaaaatgcaagcgttgcaccaaccagataaagcaccttcggaatgccaaaaagctggcttaccagaacagttccaaaatctgcttccttggaagctttcgttaccagaataccggttgacagagaaatcagaagcgatgggatctgggaacaaagtccgtcaccgatggtgaggataccatattgctggatcgcttctgcaaagcttaatccctggctcatcacgcccatgaccgtaccaccgatcaggttgataaatgtaatgataagacctgccgttgcatctcccttaacatactttgtagcaccatccatggaaccaaagaaagcggattcttcctgaatcttatttctgcgctcccttgcttccttctctgtgatcgctccggtgtttaagtcagcgtcgatcgccatctgtttacccggcattgcatccagtgtgaaacgtgctgttacctctgcaactcgctcagaacctttattaataactacaaactggataataatgagtacaatgaatatgattgcaccaatgacaagatcaccgccacctacgaactggccaaacgttgtgacaacattaccaggtgctcctgttgaaaggatcagtctggtagacgacacgttcagtgaaattctaaaaatagtcgtgaacagtaaaagagtcgggaagaaagacatatccagtacttccttcacgaataatgtattaaacagtataattaacgcgatagaaatattgatcgcgatcatcacatccaacaaggtggaactgattggaacaatgaaaaaaataacggccgcaagtaaatataacgctacgccaatgtccgcttttttcatgccttttcctccttagtcactctcaaattatttttctctcatattgtaaaccattgcgaggatctcggcaactgcctgatacagttccggtggaatttcctgtccgatatccacgtttgcatacagcatccgcgcaagtggtttgttttccacaatctcaatatgatgttctctggcagcctctttgattttctgtgccagataatcttctccctttgcaagaacaaccggtgcctttgatgtctcagcatcatacttgatcgcaactgcaaagtgagtcgggttcgtgatgacaacgtccgcttttggaacatcctgcatcatacgtcttctggaagcctcacgcatacgctgtctctgtctgcctttgatttccggattaccctctgtatttttaaactcgtccttcacttcctgtttggtcatcttcatatcttcattaaaacgatacttctgataaataaaatctgccagaccgatcactaaatagacgagactgattttcagaccagcattgatgatcaccgttccgcaaagcatgatcgcctgcatcagtgggatctcatataggataaaaatgtcctgtgcatgacctctgatcgaggtatatgccacatagacgataacaaaaattttaagaatagatttgaccagttcaaaaatagaatcttttgaaaaaattcttttaaatccattgattggattaaatttatcgaatttgggctgcaacggtttccctgtcactttccacccaacctggatcacactgatcagcgccgtcacaacaaatccaaatgcaaaaaagggaacacagacgatcagaatctgtatcagtgcatcggacataagcgctgtgactgacttttccgtcacatcaacggcattctcccttacaaaatccggtatcctgccatagatatccacaaaactattcatgagtctgttacccacaaatgaaacaaaaattttcaggacaagaaataaaatgatcaggtcaaatgccgccgtaagttctttactttttacgactttgccgtcctctcttgcctccctcagtttctttgctgtcgccggttctgttttttcaccaccgggtccgtcctttgcaaaccactgaagatcccattccatgatcaaatgtaactgtttctgctgttccaagtcaatacattccttctataaaaagtaccatcaattttttcatttccgtaaaaatgaaatttgccacacttggcagcaatgatacggtcagaaaaagtacaacaaatccaaccataatcttcatctgcatacctaccgcaaacatattcatctgcggtgaaaccttcgccatgataccaaggatacagtttaagatcatgatacatgcaaataccggcaaaatgatacggaatgctatcacaaacatgtctcccatataagttgtcatggatctcatcagatgctcccagtcaaacacctgtccattgaccggtatgactgtaaatgcatccacaaaggcccgtaatatataatgatgcatgtcggttactacaagcagcatcagtataaaataattatacagatttccagttaatgttacctgcgcgttgttgatcggatcaaattcggttgccattgacagaccgatatccatatcaatgatattacccgcaaataaaataatggaattacaaacgtttgcagcaagtccgatcagcaaccctgtaattccctctttcaaaacaatgactgcatatcctataatcccggtatattcaacctgtgaaacatctgcaaacccagacaccagaagtgcgatcatcgcagaaagccctatcttcacctgattcggcacattcgacatcccataaaaaggtgcaatgtatacaaagcaggatacgcgaacaagtattaagataaaaatttcaaaattttccaatgaaaatgaatactgcaccatatgtcaaacctatccaagataaatactgaagttcgaccataaggtcgtcacaaattccgacagctgattcagaatccacgaaccacataccatcaatccaataaatactgccacaatctttggtacaaatgtaagtgtctgctcctgaatcgaagtgactgtctgaaaaatactgataatcaaaccaaccaccagcgaaattatcaaaaccggggcactacagataataatataataaattgcatcttttgcgatatcaagaacctgtccctctgttatcatatctcatcacctcagattccactaataaaacgtttttacaaggcttccgatcactaaatcccatccgtctgccagaataaaaagcaatattttaaatggcagggagatcgttgtcggaggcagcatcatcatacccatggacatcagcacggatgccacgaccatatcaattacgataaacggaatataaatcacgaaaccgataataaatgcagttctcaattcacttaagataaatgccgggatcagagtcgtcatcggaacatcatcataactgtcataggtttcatctgaaatatccacaaacagctttaaatctttttcctgcgtctgaccgtacatgaattccctgattggtccttgtgcgatggtaaatgcctcttccgtcgtaatctcacccttgtcaagaggctggatcgcctctgtattgatctgctggaatgtcggccacataatgaaaaatgtcaaaaataaagccaacgcgatcaatacctgattaggtggtgcggtctgcgttccaattgcggtacgcagaaaatgtaatacaatgataattcttgtataagaagtcagcatgatcagtatcgatggtgccagtgataaaattgtcaataccaaaagcatcttcaccggtgccgacaatgatccgccatcattgttgtatgaaattgtcaatccatttgtactgtcttctgctgctctggtgacaccaccctctgaattgtcaccatcaaatgttgtgatactgtccggatccatggaagctgcatacacagttgttccacccgctgaccatgaaagcgtcagaacaagtaccaccattgccacaattagtgacaccatacaatatgtctttttcactcttgtcataatcaaaacctatttcttaggaaaatgttccttcacccggttcaatacctcacggaaattctcctgtgcagccttcccatccatcggaaatctgttttgtgccgcagagagatccggtacttcgcttaattgttcttctgtaagctgtgtgagcagtgtcacatcatcttttccaacagctacaacaaggtaaacctcacctgcttttacaattgcaataaacttattatttccaacacgtattgattccacaatctgcagatttttgtttgcaaaatttgttttctgataattaccgatccactttgttgtgaaataggtgatcgccagcacaaagagaaaaatgatcaatacgcccaacagctggataaaactgcctaatgcagaactgagtaatatcatattaacctacaacttttttcactgcttcaagaacacgctctgcctggaatggtttgacgataaagtcttttgctcctgcctggattgcttcgataaccatagcctgctgtcccattgcagaacacataataattttagctcctggatctaatgctttgatcttctttaatgcttcaataccatccatctcaggcattgtgatatccattaatacaagatctggttttgcttctggatatttttctactgctttctgtccgttttctgcctctgcagcaatctcataaccattctttgttaagatatccttaatcatcattctcataaatgctgcgtcatcgcaaatcattactttagccatattatttgtttctcctcttctttcctatcttatttcacaatttcagtgattctcacaccaaaactttcttcaattactacgacttcacccttggcaacgtattttccgtttaccagaatatctattggttcaccggcaattcgattcaactcgataatcgtaccaggtgcgaaatccaaaatctcatggatcgactttgttgttcttccaagttctactgtcacttcaagtggaacatccatgatcaatccgatgttctctgctcctgcaacctgtgcaatacttggattaaaagcctgaaactgtgccggctgtacatttaccggctgtgcatacatttgattcatattcggtgccatcattggctgtcccatcatcggctgtcccatcatcggctgccccatcattggctgtcccataacctgctgacctcccatcggctgttccatctgaggctgtggtgcagctggctgtgcactcactgctttttctgcctcgttcgatgtggaattggtatccgcttccatattctttgtaatgcttgcgcacatctccttcgcaaaagaaaccggatacaactgcatgatctcactgtctaccagatctccaatctccatcttaaatgaaatcttaacaaacgaaccggataaaaaatctgcgattgatccctcatcaatattatcatgaagatccacaagatctgcaactggcggactgatatcgatggtcttattcagcatagaggaaagagaggtcgctgcggaacccatcatctgattcatcgcttcgctgattgcacttaaatgtaactctccaagttctccatctgtattagtaccatcaccacccatcatcaggtctgtaatgacttttacatcatgttcttttaaaacaagaatattacttccatccaaaccaactgtatatgcaattcggataaatacacacggtttttcatatgcatcacagatgtcactccatgttgcaaaagatacaaccggcgttgaaatatctactttacgatttacaagggaaaacaatgttgttgccgctgttcccatgctgatgttaccaatttcgccaatcgcgtctttctcagcatctgtcagcaaatcatttttatttgcatcatccgggttattcagcaaagcactgatttcttcctgtgacaaaacaccatccattactactgctcctctcttaccactgatgtaactcttactgcataattatcgccgacagctcccggcagagcagtaaatttttttatattaccgacaaaaatattcagatcctgattcacacccgaatccagccggataatatctccaacctgaagatttacaaaatcgtccacggaaatagtactgtttcccaaaaccgcttttacaggaatcttcgcttttgagatcaaagcttcgatcgcatctgtatactgcttatcgtcatgttcctgaagattggaataccagaacttcgtattcagcttgtccatgacactttccaatgtcagatacggaagacagatattcataagaccttccacatcgccaatcttgatatgtaatgtcacaagtgcgatcatctcggtcggcgaaataatctgcgcaaactgtgagtttgtctcaatccgttcaagccgcggtgaaatctcacagacactcgaccaaggctccggcaaaagacttacacatacattatagattctctccagaatcaaaagttcaatctcggagaaatctcttggcttatctaacggagttcccaatccaccgagcattcggtcaacaattgcataccccagattgtctgcaagttctataataatactgccactcaaaggcgatacattcaccaatccgagtaaaaccggatttgacagtgcattcgtgaattcagaataggtaaccgcctctgaattcatcacttccacctgtactgtttttctcaaataaacaggtaagttcgtcgaaagaagtcttccataatgttcaaaaatgatttccaacgtacgcaaatgctcttttgagaactttgctggacgggtaaaatcataattttttacttgtttttcgtcttttactttcatgtcctcagcatcaagttcaccactgctcaatgcctgcagaagactatctatctcattttgagataagacttcacccattctctttcaccacctagcattctaatttactgcgtatttacactggagaaacttaccccaacgataaagtcagaaccgaacatctcctgcagatcttcgagaatagcatctttaacgctctgctcgtcctcccggaactgttccattgtatatccggaaacaatcgtgttgatatcatttttgatcaatgtttccttcgctttcaatccttctgtacctatgctcttgtatccgtcactctttgtattcagcgacaaaccgatagaaaatacagccacatggtcttttccatcaccgcttggacttaagttgacggtaaagctggcttcaatatcataaacttcaatatcttccaccggaactgctgcggtatctttgctgcttccatcttccagctccagatcaattgctgatgcgatcttatcgatcagctgatttgattttctcgtctgaggaatgatcgtaaacgcaagaattgcagtcaaaacgagattcaccagaactaatgcaaggataattactgtcatcagattctttttcattgtttgtgcctttcttctgctaattagtttatttcggaataatatgaattatatatctttatctcaacacgtctgttgcgcgcccttccctccggtgtggaattatctgcaatcggaacgtattcgcctcttccggatgacttgatatgtgacggatcgatcgttgtgatattgcgcatataatctgccacatataatgccctgtacattgacagcacatcgttattttcatattttgaagaatgcgtgaacggaatattatccgtgtgtccctctatctctatcatgttctgctgataactctgaagaatctttccaatcttatccatcaaaggataggcttctgacttgatctcagattttccggaatcaaacagcactgcaccatttaaattcaacagcacatattccgcattaaaatcgatttccacctgatcctgtatgccatattgtgctacaagatcctgcacctgctctgccatctgttctgactcggcaagcgcttcttctttatactcttccgcaacatctgaactttctgatgtatcatctgtcgtctgcgtatttgccatctgattataatagatgtcatacatctgtaactggctcacgccggaagaaaccatctcaccatctccgatggaagctccaccactcggcagaatactaaagctgctctgcaaagatgcaatcaccatctcaaacttctcagcatccactgttgacatagaaaacagtaaaacgaaaaagcaaagaagtaaattcataagatcactaaacgtcgccatccatgccggagcgcctgccggtgcttcttctgtcttctttcttgccactatgcttcacctccggctgcttcatcaccttctccgagacttcctgctgcctgtggtgtcaggaatgatttcagcttttcttcaatgacacgcggattttcacctgcctgaatggaaagcaatccttccacgatcatttcttttattgcaacttctctctcattattcaccttaagctttgacgcagttggattacaaagccagttggcgatcaatgaaccatataatgtagtgaccagggcaaccgacatagccggtccgatactcgatgcatcttccagattcttaagcatgttaataagaccgatcagcgtaccgatcataccccatgcaggacctaattctgcccatttctcccagaatgcgattactttcttatgtctttcttccatacaggacaggcttgtctccatgatgccacgcaccagttccggatccgtaccatccacaacaagcattacgccctttttcataaaatcgtcttcaatatcattggctgcttcctctaatgcgagcaatccttcttttcttgccacattagagagatcaatgatctttttgatcgtctctgccggatcttctgccttttccttgaaggtaagtgtaatacccttcagtccgttaatgaaatccggtaacttgtgtgctgccagtacaccggagatagaacctccgactgttatgatgatagacgccggatcaaccatgtttttcaaagcttcaaatccaccattactgaaaacaccgaatacaaacattactgcgccgagtattataccggctaaagatgcgatatccatatcttccacctgccatccttgttaatatatttaaaatttaattttcattttctgcttcaaatccagtttccataatttcccgcttatatgattttactaaactttttatctgttgtctactttcttttacaattatttttcgtcctgtcgtgaaagtgatcacggtatccggtgtttcttcgacaagttcgatcagatccgcattcaccaaaatctgtgtaccatttaatcttgtcacttcgatcatagtgttcatcctttccttattgttaacagacaatgaaaacaatgaaacaacgtttagtataccatatcttgttgtagtatggaacatatttactaaataatcgttactttttttatactatttctattcaaggaggaatctgtaacgttttatagattcctccattcagtttatattatcgttttaagtttacaagttcctctaataatgtatcggaggttgtaataacacgggagtttgcctggaatccacgctgtgttgtgatcatggatgtaaactctgaggaaagatctacgttcgacatttccagctcgccggttgtcatggaagaaccgtctgcggaaatctccacaccgattccatcgaactcaccggagtttaaggttgtgcggtagcagctctctccgactttctcaagaccggatgcgttagagaactgtgcaactgcgatctgtcctagcagctctgtgttaccattgtcatatgtaccgtagatacgtccgcttgtatcaatgaaaatacctgtcatggcaccaagcttacgtccttttccggttgtaccgtccactgctccggcatctgcaccgattgtggatttaccaccgttctcatagtttaagcactgtgagaagtccacagtgatattctggaagtttccgttgttgttgatcagacctgaagagagtgcccccatgttcagcattacagatggattctccccaccaatagacttaaacttacctgaactcgtatcaaattccagatcgtaagaagtctgctctcccgtcagggtcgcatgcccggtttgcgcatcaaaatccaccttatagttatttgtattatttttgacattattggcaatggttgttgtgataccggaaaagatatccgtgatgcttaccttatttgtctgattcccctgctcctcaaatacagtaggatctgttgttgactgcttaaattttttaccagttgaatctacatatgccttatctgcgttatcgtatgtataatcttttgtcagaccatattgtccaagtgttgcattcgcattgtaattaccaaaaatctgtgcgatctgctgtttatcaagatctgcgataatattcttattattgctgtccaaaacagatgtcagctctaccgtatactttccatcggttccagtagacttgattgcaaacttcgcagtatactgatagccaaggttatcgtagaagtttaagttcattaccctgccggcatcatttttaacatctgtatcattctcatccagcacaccggcgatggttgcctgtgtggttgcttccggtgcagaagtcaggttcttctcctgcatgatacggagtgccgaaacagtgtccttgcggatctcacctgttgtctcgtcaacctgccatcccataaccgtatagcctgttgaggacatacacaagttaccggaaccgtctacgtagaaagaaccggaacgggtaaatacattctcagaaccattgtttacaataaagaagttcgttgagtttttatcagtcagacggatatcaaatggatttccggttgtctcagacgcacctgcagaagtgatgctgactttggttgctgccgcagttgtaccgagaccgatctgctttgcattgacaccgccggtaccggttgttgcatttgctccggatgcattcgaagtggtctgatataagatatcactgaatgttacggaagaagatttaaaagctactgtgttgacgttggcgatattattaccgatcacgtccattcttgtctgatgtgtctttaaacctgacacagcagagtacattgatctcatcataatgaaatgacctcctaaagttcttttggcgcagggtgtctggtttcttctgtcagtcagaaaccgagtgctcccctaaggtccagctatatgatcactgcgccatcaatattggtataaatgttgtcatcggattccgtgcggtccattgctgtcacaactgttttgtttgggacatttacaatgaatgccagagaatcaacgattacgagtgactcccgaattcccttttcacttgctttttgaactccactctccagccgttcgctctgttcttttgacagattgatctttctgttctccagtctcatggaggcatgtttggaaaatttcagttccaagctctcagaaacatcctgtttctgttttaaaatttcctcaaaggacaatcctgatgcattgactgcggaatttccttttccggtaccaagataacggtccgtgatctgttcaatcgaagtgaattggttattaattttattcataaccccatctcctgttactctgtcctgtctgaactgttatcggttgtatctcctgatcctgcacttcctgtttcttctgttttgtctgtactatcagatttgtctgtgctatccgtcttgcctgtactgtcagtcttgtctgtgctgtccgtcttgcctgtgctgtcagctttgtctgtactgtccgtcttgtctgtgctgtcagtcttgtctgttccatccgctttgtcagatttgtctgttttgtcagatccatctgcagatccgtttgccttgatcagttcttttaatcttgcctcaagttcttcaaacttcttccaggaatctttggaaacgaatttcttctggtaatcgctcagtccatcatacatcttacggatgctctcaatatcatctttgtttgcaagcgagattgaatttttggatggcagtaatgaaattgcggatttaattgtctctgcaagtgtcactgcttccatataagttgcgtctgcaacagtatccagatccttcaggttgtaaagtccatcattgacagaaagaaatgtttctccgtttttgtgaagtacataatcacaggttcctgcgatatagcttgtctctcctgttgtagatgaagtcactttcatgatgacatacttgccaaccagatcatttgccgaagaagcctcgatcgtactctgcacactaagctgtgactccaactgtgagaaggtcgcaagctgtgcaatatactcggtattacttgtcggttccaacggatcctgatactgcatctctgcgcataaaatctgtaagaactggtcataaccaagctcgttggtctttttatctttgtcggacgattttgttgatgtactgcctgtaccggtagtctcatctacaaattttccatcttttacctgctgaattaatgccattgtctctctcctttctcaaaacttatgcagtgtaatctacactgtttccctgttctgccatcattttggctgccagagtttcttcttccgacatcacgccggataattcacttaaatcattcagatttaatctgtgggttctgcctttttctttttcctgctgctcgccctgctgtttttcaccttctgcattctgctcaaggtttttctcaaactcatggcttgcaacggtcacttcaacagcatccactttcacaccagcctgctctaaattctgtctgagttctacggtctgggcttctaatgcctcttttaccactgcattctgtgtcatgatctttgctgtcactgcaccttcctgctcggtaaccttaagaatgatctttccgaggttctgcgggttcagctgtaactccatgctcgtcttatcttctgtcaggatcactcttgcggactctacgatctgatcgatcacatcctgtgtatttacactctgcggtaatggttctactgtctcaacattagcaaattcctgtaccacatgactctgtggtgtgataaccgccccgtctgcagtatgggctgtctcatttgtaaaacggaacctgcctggtgtatcagaagaatcgttctgatctgtggaatcctctgccgcattttcagatgtcatcccattctgtacagtttcctgttccggaatatcttccgttacctcagaagactgtgtatcctgcgcaggcgcattttctgccgcttttgtctgtcttccatcctctaccgcaaatttctgtgttgatgcaccggtatcccctgtggctgtctgatctgtaacaactgcctcatccacagatgcttctgtttcctgtccggtaacagcatctgacgatccggcattatcgtccatcactttggcaactgcgctctgaaactcttccagactcatgtcaagtgcatttaaaatatcttttccaatgtcattgacactctgcagtacatttacaaactgttcactgcacaaaagctgtggtacgctgtctgctccggtaagttctgccacaagatttgcaagattattctgattcagcagatcctggaactgtaagccaagggtctgcattgctgcttcaatcgcttcatcggacacgccaagctcctctttcagaacttcttttacatcttctgtaaactgttcgaactgctctttgacaacatcctcagatgtgacctgttttatctctgatgcgatcgtattatccttgtactgatacttctgataatcatctgccgctttcacagtgtccttactgccatttgctgctgtctttactgttttgttgtggtcaatccctgcataagatgctgtctgacggtttccggactgtttcatcatagaaccaaaatctacttttccagtggtgatccgggtattgctttctgtcccctgcacagactgtgtgctttggttaaacatttttcctaattcagaaattgttgtaccagccatatgcttcctcctttcttcttttatcgtcttactgtctggcagtatgcactgcccggaaaagatcctcagatctctccctctattctgaaggttccatgatctcagttacttttgctgccgtatctgagttcatcttaccgagaatatctcctctggactgtgtgtccatattggataatatatctgctaccaattgaaggttgtctgtcattgtatcaaaaatagctgccgcctctttcggcttcatgctggaataagtcttcacataatcatccatctgttcatccgtcagagtctgttctaccacctgtttataaagcacttccgcatttgccgcatcaatgctctcataatactctttgtaattacttatatcgggagcatcttccgaaaagacaacatcctcataccatttttctttttccttctcaaaatctgcctcattctgcttataggtatccagctctttcgccttctcctctaactgtgtaatataatctgcatcagaatttgcactgttctgggcatctgcaagctcaatctcaagctctttgatccggttgatcgcatcatccagatttgtgtatgcatactggctgtcttccgtggaaatctcctctgtgacagaatccggcaaaatcttattcagataaggaacatctttgatcacaggagctaagactcccgagccaaatccgcccacatccagcttgatcagcattgcaaagatggcaagccagatcagaatgataataatcgtgacaaagaaaacaaggatttttcctccaacggtttcctcatctccatccagatcatctggatttttctgttttctcttctttttttccagcttttttgccgcctttaactgttttttatctaaaacttcattttccttctgtaattcttcctgctgcttttgttctgccataatctcgtccatgcctttctcgtatattgccctgtcaaaattaccgggtttctgtcatcccctcatgataggtgtaacttacaagctcatcaatttctttattctctgcatattgcatttcctgtttaaaaacttcaaacgcctgctctttcagtctctcatgcgtctttctttccatcatgacttcattgagtttcaaccgggcagcctctacatttttttctgcgacatgcacattcatcatctggctgcgctgcatcgttttcatggtatctactgcccgcttgcattctttgatcttaggtacatcaatggttccattcaccaaatttctcgcctggctttcataacctgccttgcgtatcatgatctgctggagttttccctgttcatccatgagttttgcatttgcaactccatatgcgattttcgcctggccttccattttttcttttatatctaatatgctttgcatccgatatgcaaattttgccatatcctatcaacctctaatcattaaaaagtgcacgcagcagatcgatctcctgttcaaactggaatttttcgtcggtcttctgcatcaggaaatcatttacagcatcgattttctggatggcataatcgatattcctgttagaaccgctcttataggctccaatattgatcagatcttccgcctcattgtatgtagcaagtacattttttaacctgcctgccagttctttatgttccggcgttgcaatggaactcataaccctggaaatactctgtaaaatatcaatggccggatagtggtttttatgtcccagttttctggacagcatgatgtgtccgtctaaaatgctccgggctgtatctgtgatcggttcattaaaatcatcaccatctaccagtactgtatataatccggtgatcgatcctttatctgaagttcctgcacgctctaacagttttggcatctccgaatatacactcggcggatatcctctggttacaggcggttctccggatgcaagtccgatctcgcgctgtgccatggaaaaacgtgtcagggaatccatcatcagaagcacatcttttccctgatccctgaaatactctgcaatggatgtcgccgtcattgctgccttcttacggatcaatgccggtttgtcagaagtcgccacaacgacaatggaacgtttcataccctcttctccaagatcccgttccacaaattcgcgcacctcacggccacgctcaccgatcagggcaatgacattgatatctgcctttgtatttcttgcaaacataccaagcagtgtactttttccgacaccggaacctgcaaaaattccgatacgctgtccttttccgactgtgatcaatccgtcgaccgctttcacgccgagaggaagcacctcactgatgatctttcttgacatcggatccggaggctgtgcatcgaccggatattcatacggtgtttctaatttgtcaatgtccgttggacgtccaattccgtctaaggtatgccctaagagttcatttcctacaggaacagataaaggatgccccgtattttcaacgatacatcctactcctatcccctctacgctctcataaggcatcaaaagcagtcttttatccctgaaacccacaacctcagccattaccacggtgtcagcattttcatcaatgataattctgcacaagtcattcagttttgcgtccggacctacggattcaatggtcaatccaacaattttaacaacttttccaagccgtttaaaatatgtattctccgccagtcgtaaatacttgttatacctgctgtccactttcaaccatccttataagcatagtgattttatatcttttatgagattttcgagctgcacaccaaggctgcagtcgaatacccccgagtctgtctcgatcacgcaggaatttccatccatggaggaatctgcgacaatctcgatctcgatcccggctcccactcgttccaaaatttcttctttatgattctcaagaaacatcacattgctgttagcaaccttaatgcggaattttttatctccctcgatatttaaaattgcatcatcgatgagatacatcagaatgtgctttttattatcaaactgaatatggaatactttgttaaaaacctcaaggatcacatctaccagatccttttccatatttttttgtttctccctgaattcatcctgaagcgtttcctgttttctctgatattcattctgtaactgttcacgctgtgccgccagctcactctccaggcactgtcttccctcctgatatccggtattttttgcattctcccggatattttcagcttcctgatctgcctgacttaaaattgtttctgcctgcgcatgtgcttccgctaaaatcttctcagcctctttttttgcttctgcagtatggtcgatctcctccacataatctgtgtcaggaccaacgatccctgctgagaaaccatttccgtctgttgttttttgttccatgcgcttaagctctgccatcttctctaaacgcttttctacaatatcatttgagttaatgacgcgtgttttatccggctcattgtgcacgaaatattgtttgtaaagattaggcaataatctcgtcacctccgcctcttgaaattacaatctcacctgcatcttcaagttttcggatcacactgacaatcttctgctgtgcctcctcaacatccttcatacgcacaggtcccataaattccatatcctctttgatcatggcagccagacgttttgacaggttgttaaagattgcattctgaacatcttcgtttgcacccttcaatgcaataccaagatctgagttttcaacatcacgaagaacacgctggatagctctgtcatcgagaagaaggatatcctcaaatacgaacatcttcttacggatttcatctgcaagctcaggttcttcaatttcaagagattccataatatgcttctctgtagaacggtctaccgtatttaagatattcacgatcgcatcgacacctccgacaatcgtgtaatcctggttgaccagagaagaaagtcttctttctaacactcgctccacctctttgatcacatccggtgatgtacgatccatcattgcgatcctctttgcaacatccgcctgtttctccggtggaagtgctcctaaaaccatcgccgcctgcgatgctgtcagatatgataaaatcattgcgatcgtctgtggatgctcatcctggataaagttcaaaagctgactcggatctgtcttccgcacgaactcgaatgggcggacctgtaaggaagcagtcagcttggagataacctcctgtgctttttcctgtccaagagccttatcaagaagctcttttgcataaccgataccaccctctgcgatatactgctgtgccagacacacctgataaaactcatttaaaatatcttcttttacctgtggagacacgcttcttgtatttgcgatctccagcgtaagttcctcaatctcttcttctttcagatgtttaaaaatatctgcggaacgttcaggtcctaatgtaatcagcaggattgcggctttctgaacgccattgtaatctgcagttgccatattctactcccactcctcattcagccagtttctaagtaaggaagctgccgcttccggattttcttctacgaatttttctatcaggactcttgtctctgatttttcattgaatccgatatcctgtaatgtatctgcagattctttggtggattcaagcagagactccacggaaagttccggctccggctcgactgctttctcttttcttgtgctgcggaatactacataacctaacagtgcaaaaatcaatactgcaaggatgatctgcagataatccgatatggtccgtgtacttcctttgctatactggaacatcggctgatcatatgcaatgatcgtgatattgctcaccggtacgcctgttgcattggagatcagcgtataaagatcctggtctacttccgcctttaccggttcactgtttgcagcaacatactcatcaaaggtcatgtcaccgagcgttccggaagccctcaatgtatcctcatcatagatcacatagttcgttgcgactgctgatatggatgagccgtcataattaacagtccccactgcaggtgttgttgttgtgatcttctcgttattctggtagtttgtattcgtctcagacacactggaactcgtgtaatcattatcttctagtacataagtcgtatcatcgtcattggaatcggttcccggtgttgccgctgctccaccgactgcattcgattcatattcactctttgatcccaccataccgtttgtctgtccatccggcgcataatactcatgtgtggattctgtggtctggtcaaaattcatcgcaagattcaggccgacttctacattatcaaacagtgatgatcctacaaggacatcttttacctgaccttttacctgattttccgctttggtctttaaagacaactggttgttggcatttcctgtcacggatgtatcatcctgaccagagaaaagaacatttgaactattatcgaggatgagcacattggatgtgtcatcatttccaacatttgttgcaagatattttgcaagtccggctgcctgttcatcatccatcgttccgttgagcgtcaggatcgctgtcacatatgcctgttcacctttggagaggatcgttccatcttcatccggcagatccagtgtcactgccgctgcatctacattcgataatgtctcaagcttctcagcataatactcttcgagatataatttgtactttttggtcttgtctgcctcagtggaactgaaacctccatcaaacacgtcgcttagcttcgtgccgctggttggaatatcatttgttccaagaacgatggaagcatttgcgtaatccttttcatttacctgaaaggcaagtccatcagcggagagttcataggaaatattctcagagtcaagtatgttcttgacctgcccggattctgctgttgtttcgcaggtaactaatgttaccattttaggcttggaaacgactgccgcaagaattgcaagagccacaagcacaactgccacaatgctgatcagcagtgtcttttgttttgtattgaattttttccaccattctaggattctgtctaaaaccttttgtacctgttccggcattttcatctaccctcgttcactaaatttgcatattcataatttctttgtatgcatcgatcattttatctctcactgccaccgtatactggatcgcagtaagtgctttggtctgtgccgttgacagatcatgtgtgttctctgactgtcccaatgcaaaacggatcgcctctgactgtgcgttgttctgcaggttgtttgtctctgaaaccatattcatcgcagatgaaaggacagaactgaacgaatcatcatctgtcgtgaccagcctgttctgctgtgcgatctgattcagataatctgaactgatatttgtcaatgaactgatatccatatatcataccaccttacttatcttttatctttacttattttccaatggagagtccgctctgtgcaattgattttgcagcctcgaatgctgttgtgtttgcctcatacgcacgggatgcatcaataaggttcgtcatctctgtgaccgtattcacattcggataagaaacataaccattctcatccgcatccggattggacggatcatactccatgataaaatcagtctctgtgtcctctttgacagaagatactttcacaccatttccgacaaacttagatctggcattctgataataccttgagaaagaagtcacttccttctctgcaaaagtaacaatttttcttcggtatggagttccatcttctgttcttgtcgtatttacatttgcaatattctctgcaatggtatccatacggaaacgctccgcagtcattcccgaagcactgatatcaaacgcctgaaataaagccatttttatcctcctgtaatcctgctcttattttactttaaaactgcctgcattctcgtaaaatcagaggtgatgctgttcgtaagtgcctgataacggatcgtctccgatgccagttccacattctcggtatccggatccacgttgttccggtccagacggtaagaataatttgatgagtctgtatgggtagatacattcagaccggaaagatccgcatttaaggaacggattttcttgtccagcgttgtgtatttggagtggcctaattctctctgaagtacagactcaaaatccacttcctgtctcttatatcccggcgtatctgtgttcgcaagattattcataatcgcagtctcacgaagccagcttgcatccgccgctttatccaacacattgatatagtcaaatgcgttcgtagtaatcatgacacattccccttccaatttacataattcaacagtaacctagttttattataaagaataaatcaaaaaacacaagtctttttttaccatttttgacatatcttgtagatttttgactttcaggcacaatatggtgttttgttttttcaatctgtgttcccgttttccatgacagatcctgcttaatgtgaaaaaaggactctatagcaagctataaaatcccttttttcacgtaaatccctttattttatgttattttctttcttgatctgttccagttcatcaaagacaacgtcattcagaactttgatataggttcccttcatgccggaagatcttgattcgatcactcctgcactctcaaacttgcggagtgcattgacgatcacagatcttgtgattcctacacggtctgcgatcttacttgcaacaagaattccctctttgccatccatctcctcaaaaatatgggtgatggcttccagttctgaaaaagaaagcgtgctgatcgcagattttacgatctggacttttcttgtctcctcagcgttctcttcatttaccgaacgcatcatctcaagtcctaccacggttgtcccatattcgctcaaaataatatcatcaatatcatacggatcattctcccggtacacaaacagtgttccgagccgctctcctgcaatgtcgatcggtgttatgatcgcagtatatttcttaatgtcattcacaaatcccaacgtctcgagattgacattctcttttgtggacaggattccaagtaaacgttcattcagcaatggatcgataaatccgccgacctcatccacgatcagctcccggatctcttccacaccatccgtcagaccggttcctaacacttttccctttttactgatcacaagaatgttagagtttaaaatatccttaagcacatcacagatatcattaaataccacttttgacgaattgttgttatgcagcaatttattgatttttcttgttttatctaacaattgaacgctcatttgacagcctcccataagtttttgctggttttttatgacattttgtattttagcacatttattcagaaaattcaatatattcaaattattcctgatttttttctttcttctctgtcacataaccgcactgctcgtctgcgcagacgattttgctgcctttcataaccatgtagccgccgcatttcgggcatttctcttctaccggacgtgaccagctcataaagtcacattccgggttattctcacagccgtaatactttctgcccttcttggtctttttgagtacgatctctttgccacatttcggacatttgacaccgattttttccagataaggttttgtgttgcggcattccgggaatccagggcaggcaaggaacttgccatgcggtccatatttcacgaccatgtttctgccacagacatcgcagactacatcggtcacttcatcctcaattttgaccttctcaagatctttttctgcagcctccactgctttttcaagatccggatagaaattctctatgactgtcttccagttaacagtcccctcgccgacactgtcgagcaggttctccatgtttgccgtgaaatgttcatccacgatagatggaaaagattccttcatgatctggtttaccacttcaccgagttctgtcacgtaaatgttcttattttcctttacaatatagcgtctagcaagaatcgttgtaatggtcggggaataggtactcgggcgtccgattccaagttcctctaatgtcttgactaaagacgcctctgtatagtgcgccggcggctgggtaaaatgctgtttttcatcaagcttttccaaagaaagttccgtactctcatcgatcgacttcaacagcacattattttctgccttttcgtcatcctcactggtatatacagacataaatccgtcaaatgcgatcttggatgctgatactgtaaaccggtaatttccggcaccgatcttcacgttggtcgtctcatataccgcagatgccatacggcttgctgcaaaacgtttccagatcagctgatacaggcggaactgatctctggaaagggaatctttcaccattgccggtgtacgattgatatcggatggacggatggcctcatgtgcatcctggatttttgcgccggactttttggcagttgtctgtgttgcaagataattttcaccgtaattttttccgatgtactcatgtgcctgtgcatctgcttcctcggaaatgcggacagagtctgtacgcaggtaagtgataagaccgaccgttccctgtcccttcacatccacaccttcatagagctgctgggcgattctcatcgtctttgagattgggaagttcagcgctttggatgcctcctgctgcagggtgctggtcgtaaatggaagcggcgcttttttcacacgctcgccctttttcacctcgatcactttaaatttctctttggagatttctgccatcacgcggtccatctcctctctcgaagagatgttcatcttgctttcgctgtctccatagaactttgcaagcaatggttttttctcacctgcgatctttaattctgcgtcaagcgtccagtattcttccgggataaaagcgttgatctcctcctcgcggtcacagatgatacgcagcgcaacggactgcactcgtccggcacttaagccacgttttacttttgcccagagcagcgggctgatcttataaccaaccatgcggtctaagatacgtctcgcctgctgcgcattcacaaggttcatgtcaatgtctctcggctgtttcaaagaggctttcactgcactctgtgtgatctcattgaaactgatgcggttgatgtccttgccctccagctttaatgctttgctaagatgccaggaaatcgcttctccctcacggtccgggtcagttgcgagatacactttatctgcttttttcacttctttgcgaagattcgcaaggatatctccttttcctcggatagtaatgtacttcggttcaaaatcatgttccacatcaatcccaagctgactctttggaagatcgcgcacatgtccgttggaagctgcaacctcataattttttcccagaaactttttaattgtcttcacctttgccggcgattccacgataaccaggtacttagccattcaactgtctccttactctcagattttgcgtatataataatttttaaaagattccgtgataaagtccttctgaatcagtctctgcaggacatctgccatctgaggcatctcaaatcctgtttttttcaaaagttcttccatacttttcggtcgtaaactcaaacaagcatacaccaagctttcatctttttcaagtaataatttgttaaaattttcttgagttgtgtcattacacgcatacaattcaagatcttttacaaaatcttctacgctgtttataatgcccgccccctgccggatcaggttattgcagcccatgcttaaggaatctgtcactcgccccggaactgcataaatatcctttccctgctccagcgcaaaatctgccgtaatcagggaaccgctcctctcttttgcctccacgatcacgactacatcagagagtgctgatatgatccggtttctggcaggaaataattgtgcgattggctcagtctccggcggatattccgagatgattcctccatgtgaaagaatatcctcatataatttctgattcgtccgcgggtaacagatgtttacgccacaccccagcaccgcataggtgtttcctcccgcttttaatgctccgatatgtccgtaagcatcaattcctcttgccatgccgcttaaaacctccgccccgcaaaacgccagtttttcaccgatctgttctgccattgcctttccgtattccgaacacattctcgccccgacgaccgccactcttctttttgagaaatcaggcattttccctttgatatataaactgtatggtgcatccacgatattcctgagctgcttaggatatgactccatctcgcaggataaaaaagagatcccgctttctcccagcgcagcatatttttcttccagattccagtttttcttccggtctgtgatcgcatgcacctggcggtcagacagcccggagagcttttctaactgctcttttttcagaaaataaatttcttccgcagaacctgcctgtcccaaaaggcggtggatcgtcttacagccgactcccggaatatttgaaagccagtactgatatttcatagcgaatccctccagaatcttttgtcaatattgcgatagcagactgcctcattcaaatgcgcatccagaatgttttcagagccgtccatatctgccagagtccgcgcaacctttaaaattttatgataagaccgggcagtcagatttaactgtttgtaaattttcttcatatatttttcctgatctttcgacagagcacagtattctgcaatccgtgcagccggaatctggctgttaaactgaaaatcttctttctgataacgttttttctggatcgcatgtacttcaatcacacgttcccggattgtatcggaacattcctcttttttcgttccgttcaattcttcaaatttaatctgtggcgtctccacacagatatcaatgcggtctaagagcggctggctgatacggttgatatatcgttcaatagaagccgccgtacatctgcatttctgcatatctggataataaccgcatttgcagggattcatggcagcgacaaggataaaatcagccggatattcatacgtgccgttcacgcgcactaaacgcacttccttttcctccatcggctgtcttaatatctcaatggtattttgcttaaattccggcaattcatccaaaaataaaacgcccttgtgtgccagagagatctctcccggctttgggatcagtccaccacccactaatccctgcatcgtaatcgtatgatgtggacagcggaacggacgttcctccattaattgttcccgtaattgaaactgtccggatacactgtaaattttcgaaagttccatctgctctttttcatcaagcggcggaaggatcgtcggtatccgcattgccgtcatggtcttacctgcaccgggtggtcctatcatcagcagattgtgcataccgctcactgccacctcacaggctctctttacaaaatgctgtccctggatatccgaaaaatcgagcatccggatcgtttttgccactgcttttcctatttctttttcaatgtatgtgcccccgtttaaaatatgtatcatttctgcaatactctgcaccgcaaaaatttctatctcttttacaagctgcgcctctgtctgattctccgccggtacgatacaacgtgtgacgccgcgttcctttacctctgccaccataggcagtattccattgacgggctttacctccccgctcaagctgatctcacccacgaccatcgtattctttaacgcttcctccggcacaatgccaatggcacaaagcactgcggcaacaaccggaaggtcgaagcctgatccggtctttctgatattggcagggataaaattgatcgtgatacgttttggcggcagaatataccctgtatttttcagtgctgtgcgcacacgctctttggattcttttacctcaggcgaaagtgaaccgaccatctcaaaaagcggcatgccatctgagacatccgcctccacatagaccgggatgctcttgatcccctggatgatcgaggttgttactaaactatacaaatacccttcctttccctcgttttctgcatcaaaaataaatgtattcgaaaatactctgtggataccgcagggaatcctgcaatgattctgataaaaaaagattccgacatccggcagaagccctcatacatctgccagatgcagttttagtatagcacattttccagattttacaatatttcttctatattataatacacctaaaatgcctgcctgagtttttcgatcgccctcttttcgatcctcgaaacataggatctggaaatcccaagttttcttgcgatctccctctgtgtcattgtctttttcccatagagtccgtaacggtttatgataataaacaattcccttccggacaatgtctgcggaataatttcattcagccgtctgactttgcgatcctgttccagcaattccacaacatcctcgtcctcgctgaccacaacatccaaaagctggatctggttcccctctttatcagttccaatcggctcatacagggaaacttctttcgacgttttcttttttgcccggaaatgcattaatagttcattgtcaatacaccttgccgcataggtcgcaagcctgctcccataatcctctttgtatgtttccactgccttgatcagtccaatggttccgatggaaatcagatcctccatctcatcctccgggttctggtatttttttgccacatgggcaaccagccgcatattgcgctcgatcagctcgtttctcgcctcaaggtcaccatttttcattttcttcagacattcgctttcctgttccatcgtcaacggagataaaaatgttttcaaaacgcaccttaaaagctttcttgatacatcttatgtttagggcaagttctccgtgcttttcctcttttaatttttcatgcttttcgctataatcgttttatggtcttaggaaaggaacgattatgacacgtgatttagaatataacataaccgcacaggacaatggtgtgaccatctctgactatctgaaaaagcagggtttttcccatgccgtgatcgtgcagttaaaaaagattccggaaagtattcttttaaatggcaaatgggaatatatgagtaccaggcttaacgacggggattgtctttttatccattttgaggaaacggaaggctctgaaaatattgttgccaccaatctccctctctccatctgttatgaagatgaggacattttagtggtaaacaaaccagccgatatgccaatccatccttccatgaacaattatgacaacacactcgccaacgctgtctgccattattaccagacacagggcattccttatacgttccgctgtgtcaaccgcttagaccgggacaccaccgggctcaccatccttgccaaacatctcatcagttccgcaatattaaacagcgaggtgtcagtccggggcataagcagggaatatcttgccattgtgaaaggtttcacagaggatgaggggacggtcaacgctccgatcgggcggaaagaaggttccacgatagaacggcagatcgatgtgcttcacggtgaaactgccatcacgcattataaaagacttgcctatcaagacggtctttccctgatctccctgaaattagagaccggacgtacccatcagatccgcgttcatatgaaatctatcgggcatccattgatcggtgattttttatacaatcctgattttacaaagataaacagacaggctctgcactcttaccggcttcgtttcacccacccggtcacaaagaaaccactggtgttcactgctcctttgccggaagatatgcaggctctttttcctgaaatgatattatgatcttttttctaactgttctttcaattgcagtaacggttctttctcatacgggattttatgtgagagaacctcttcccggataaagcggttcgttgctttttcaccttttattgcaagcatttccaacagaagttctaacaatgccctcgtatcatcatggagcacatgaaattgccgtccgttcatataatatgctaaagcactgtcgtcccggtacttttctttctggtagttcttcgatgccgctacgcggtctatatacatttccaccacataattgaccggcatcttcatgccacagagacctttgtgttcccctttatgcggtccttctttatccggtattccataatcaatccagtactccagatgatgtttatttcttcccttgtgatgcagccaggcggaagaataaccaaccgcctcacgctctgcattgttcgggctcatattgccctgatagtatttacatcctacgataaactcagtcggactgtattttgaaagatcgtgaagcagtccctgcctgatcagtccaacctgaaagcaccctctcatcacaagtattttatgatggttgatcgtgcaaaaatgtttccaaatattcatttccctgacttcctattttccaagtaataaaacgacagactgcggtctgaccgtgatcctgtgctggttttccgccagtttttcctctggcaggaaagcatgttcctgttctgcggtgtccatgactacataccatttcttcttcccggcaagcttcggcagggcaagttcattcactccggtatggaaattatagccaatatagaccatatcatccggctcaccagcatcattcacggcataatccccacagtacatcacaccaaatgctcccttttcttccgggagtcctgctgcccaggcattgtccgagtgataggacagatccggacagcccttgtgcagataatcgttcagatgcatcggttccgctttacgtatcaccggatgcgccttacggaatattgcaagtttttgtacaaactcctgcagcgcctccatgcctgtgttcctcttccaattcacccatccggttttgttatcctgacaatatgcattattattgccctgttgggaattcagtgcctcatcccctgcaaggagcagcggcactccctgtgcaaaaaacaccatggacaacgccatatataagtgttttcttcgaagttccttcacatactttcttgaagttttaccctctgtgccacagttgatgctgaaattataatttgaaccgtctgcattttcttcgccgtttgcctcattgtgtttctcacaataggaaaaaagatctgccagcgtaaagccattattgtttgccataaaattgacaaaaccgactgttttgttctgtttcttctgctgattgccaaactcaaaaaggctgccaccctgatgatttaacaattttcttcctgtataaagatactcgtcattgtatacaaacagatgcggatagttttccttctccttccacaactgctccgggatatactgataaaagatcttgcttctccgcaggaacaaatcctgggcgattgcagtgatcggcacattctccccgatcagatgaaaaccatctacacgaaattccgttgcccagtaacgaagtgcatccatgatcaggttctgattctcctcctgctcaaaatacatctccatcacgcactccatctgattctgatgcagtgcatcgatcagatgtttcaattcccgtgtcacattcttgctacagccataagaggctttcggagcaaaatagaatccttttgtatacccccagtaattgacttttaatttttctttgtctgtcccggaaccggcttccttttccggtatgctgccctgtggtatataccctggaagtttttgtttctttggaatctcaatctcctcaaactcatagaccggcatcagctccaccgtcgtcacgcctaacgctttcagatagggaatccgctcctccactgccgcaaatgttccacgcatttttccctttttcccggaatccatggaaaatcccctgacatgaagcttgtacatgaccatttcgtttttcgggatctccgggcagcacgcgctctgccattcatattctttttcttcaaaactgccacagactaagaagtcacattctgctcttctcgcatcatcccacttttctcttccagcaatcttcgatgcatagggatccggcactgtctctccattgatctcataattatataataaatgatctgccttcaacccatgtatgtaaacagatctgactgcccctctgcaaaatgcagccggagcctccaccctgccggcgacctttaaggatctgtcatataatatgacttcacacacatcttctttttctcctgcaaaagtaaaaatgacaccatcttttacgctctgcaatccaaatctcaaataattaccttctgtcaccgtatagttcattctgtcaccagccttgtatttttttcaaaaaaatgttacgacatataatattattatacctttaaccgataattttgtatagaagaatgtttttttgcatttcatgaattttttatctacacaacaggaaaaatttatgctagaattttaatgctaaatataggacggaaaggtgctttatgaaaatcgtttcaattaataacctgaaaccgggcatggtcatcagtgaagatgtcttttcctatcatgggcaatgtcttgcaaaacagaatactcctgttacactacagctgatcgaacatttaaagttctatcagattgcttctgtcagcattttccctgaaaatcatggcgaccgcaattcaagtaccatgactgcacgacgtttggaaacttattcccaacgtatccgcagaagcccggaatttcaaagatttaaaacagattataccaagaaagtttcctttatgaaggaaaatatcaataactttatcgtcaatgacgaggatctcaatgtagatcagcttctggatgaaactctgacactctttggggaaaacagtactacgatctccatgttcgatatgctgcacaatatgagacagatcgatgattccacctatgcgcacagtgtcaacgttgcactgatctgccgtctgatcggcaaatggaagaatttttccgagaaggatatggacactctgaccctctgcggtctgctgcacgatatcgggaaatccaaaattccaaatgagatcattggaaaacccggaaagcttacagattccgaatacgaagagatcaagaaacacccggtgatcggctacaatctggtcaaaaaccttgacattgaccagcgtgtcaaaaatgccgttctcttccaccatgaacggttcgatggaaaaggataccctttaggacttaccggcaacgagattgatgatttcacatccatcgtatccattgcagatgtctacgatgccatgacagccaaccgctgttaccgagatgggctgtgcccgtttgaagtgatcgcaatatttgaaaaagagggattgacacaatttaatccaaaatatatcttgacttttctcgatcatattgctaatacttatatcaataatgaagtattgttaagtgacggatcttcgggaaagatcgttctgatcaacaagaagcttacacgcccgaccatccagcttgacaatggtaacttcgttaatctggagagtcgtctggatctgtatgtccaggctattatctaataatatgaatgaaagaggtgcccaatggcagagaaaaacaagttcaacaacttagacgatgaagacatgttcgtaacactcgacttagatgacggcagttccatggaatgccagattcttaccatctttgaggcagatggccgcgattatatcgcacttcttcctgtagatgaggacgagcagccaaatgaggacggcgaagtatttatctaccgctattctgaggatgcagagggaaatccttccctggagaatattgaggatgacgaggagtacgaagtcgtatctgaccgcttcgatgaactgcttgacgaggcagaatttgaagatttagacgattaagcaaaaaagaactgatgcgctttttggaagttgcacatcagttctttttttgtgtataattttattttttctgtgattctcttatgaatctggaaatgtctgtatttttgtgattcaactgttcaatggaatagagatgcagcttcttttttgcgcgcgtcattcccacatagaacatccgccgctcctcctccacttcattgtcaagcacagcctttttataaggcataattccttcattcacatcgataatgtagacattgtcatattctaagccttttgaactgtgtagtgtggcaagtgcaacgctctccgggttctgattctgctgtctataaatcttttccagttccgccgtatagttttcgatatgctcaaaccagtcattataagtgtcgaatcccttcgcactgttctgtaactcctcaagtacctcatagagatcctccacattcattctgcggtaatctgcatactccacacagaattcatcatagccaatcccacggcggatataattgatcgccgcataagggctcatggttgagagcattttaatatcgtactccagccgctggatgcgctctgccacccacggtttatcctcgtaaaaccactcccagacatcaaacgctaccgtttcttcgtccagagagtccctgctgatatagcgtttcgggcggttcatgatttttaagaaatctttccggtaacggcttcccatcgcaattttcatgtatgcaatgatatccttcgcaatccagtgttcataaagatttggaacattatccttcatacggaatggaatgttgtattccagcagcttttccatcagcatctgcggctgcgtattcgtccggaaaagaatggcaaaatcttcgtatctgccgcctctgtccatatgcgcctgtatatcccagataattttggcgatctcttccctctggcttttaaacactgcatactcaaccggttctcctgcctcctggttcgcctgaatcttcttttggaaacgttccttattacatccgatcagacggagtgatgcctccacgatctctttttgtgaacggtaattggtatccagtaaaatctgctctgcctccggataatcgtctttaaaatgcagcataagctccggtcttgccccacggaaacgatagatggactggtcatcatctcccacgacaaacagattattttccggtgctgcaagcattttaacaatatcaaactgtatcttgttaatgtcctgaaactcatcaataaggatgtactgaaactttctctgccatgccgataaaatatcttttcgctccctgaaaagctcataagtataaacgagcatatcatcaaaatcgatcagtttatgctgatgcagatattcatgatattctccataaattcttcgaaatatattttcagcacagttcgtggaatagtaatgttcgatggagactcctgtattttttaccatactgatctctccaagaatggatgatacaaattccgtttcatcctcatactcaagacggtgtttttggacaagttcacgcataagcgcatacttttgttcttcccggacgatattatttgcattgtaattgtatgcatgctttaaaatgctaaaataaacggcgtggaatgttccaaatgtgaccggatacgaaccgtttcccatcagacttaagaaacgggtcttcatttccaatgctgccgcttttgtaaaagtaatcactaaaatattggacggactcacatgatattttgtgatcaggttttttgtccgctccgtaatgaccgctgtctttcctgagcctggacctgccagggtaaggcacggaccgttaaaatgtccgattgccttcacctgggaatcattgtatcttttttccataaatacccttttatttgctgagtaattcaataccttttttgatacgtgcaatggattcttcttttccaagaatctccattaattcggttgcaccgcccggtgtcatctgttttccggagacagcggtacggattggccacataacgtatccgttcttgacacccttttctgcaacatactcacagagcattgcataaagtgcgtcgttgctatagtcctcctgcgcctctaatcttggcagaacttccgttaaaacttctaaagatgtctctgcatttgtcttcatcttcttgtgtgtatacattgcaacatcgtactctggtaatttttcgaagaaatcaatatgttctgcaatatccgggaacacttcgattcttgtttttaccatagctgcgatctttttaaagtcaaggtctttcgtaataactgccttgatatatggaagtgctctctcatagaacttgtcaaaatccattgccttaatgtattcaccattcatccattttaacttggtgtagtcaaatactgccggtgatttgctgattctgtggtaatcgaattctttgatcagttcatctaaggtaaagatctcgcggttatcttccgggctccatcctaaaagtgcaatataattgacaactgcttctgtcaggaatccctgctcgatcagatcttcaaaagaggaatgtccgcttctcttagacagcttcttgtggttctcgtctgtgatcagtggcagatggatataaacaggtgatttccagccaaatgcatcgtataatctctgatattttggagaggaagaaaggtactcatttcctcttactacatgcgtaatattcatagtatgatcatcgacaacgttggcaaagttgtaagttggatatccgtctgatttgatcaggatcatatcgtcaagctctgcgttctccactgtaatgtctccgtataattcgtcatgaaaagtcgtagttccttcatttgggatattctgacggatcacaaatggtttgccggcagcaaggtttgcctccacttcctccttggttaaagaaaggcagtgtttgtcatagatcatgatctcttttccctctacaacctctgtctttaaagtagaaaggcgttctttatcacagaaacagtaataagcctcacccttttctactaattcttttgcgtatttcatgtagattccggttttcatacgctcactctggacgtatggtccataaccgccatccttatccggaccttcatcatggactaagcctgtctcagccaatgtacgataaatgatatctaccgcgccctctacgaaacgttcctgatcggtatcctcaatacgaagcataaagtctccgccctcatgctttgcaattaaaaactcatataatgcagaacgtaaatttccaacatgcattctacctgttgggcttggtgcaaatcttgttctaactttactcataaatctcctctttctggttttttgataaaaccttacgttttctatccaatagactgacttgttttcatccgctctattgtcctgtaaaaaatagcctgcagctatttttagtcgctacaggctattatataatatatttttcattctgacaaggcacggtttacattccatcgccgtcatttttttcacattttttgcagtttttccctgcacagccactgcatccaatgcagttgcctctcttcttctgtctgtgcatccagcaaaaagcgagcaccagccagagtaagatcacaccaaggacaatataatctccaattttcattacaataataatcctccgacctgataaacaagcaatgcgactacccatgcaaccagacattgtaaaacgactaccaaagctgcctttaatccacttcccatctcacgttttaccgctgcaattgccgccacgcaaggtgtatacaataaggtaaataccaaaaagctcacaacagacacaccggaaaacatatcgcttaatacggcactcaggttcgatgttgcagttcctgtgaggacactcaatgtactgactaccgcttcttttgcagtaaatccggtgatgagtgcggtagaaactctccagtcagagaacccaagcggtgcaaaaacaggtgcgatccatcttcctaccaatgcaagcagactgttgctgctgtctgccacaacgttcaatctggtgtcaaaggtctgtaagaaccagataatgatcgttgccacaaaaataacggtaaacgctctctggataaaatcttttgccttatcccacatcaactggaatacactctttgcggaaggaaaacggtaattcggaagttccatcacaaacgggatcggatttccacgaaatgccgtatggttcagcacaagcgccgaaataattccaactatgattccggcagcatagagaaggatcattaccagagcttcttttccggggaaaaatgctgcggcaaacacggtataaattggtatctttgcggaacagctcataaacggagtcagcatgatcgtcatatttctgtcacgctcggatgacaatgttcttgtcgccataactgccgggacagtacatccaaatccgatcagcattggcacaaaacttctgccggacaaaccaatttttcttaacggtttatccatgacaaatgcaactcgcgccatataaccggaatcttccagaatagacaggaagaaaaacaatactacgataatcgggaggaaactcaacacacttcccacacctgcaaacacaccatcgatcagaaggctgtgtaccaccggattcattccgtaagcagtcagtgccctgtcacacattgcagtaaacgcatcaattcccattgttaacagatcacttaaaaatgatccgatcacgttaaaggtcagccagaaaattgcaaacatgatcagtaaaaacatcgggattgcaaggtatttatctgttaaaaccctgtcaatcttcatacttctgatatgttccttactctcatgacatttcttgaccgtcttattacatactttttcgataaaggtgtatctcatatctgccaaagcagcattccggtctaatccacagtctttttccatctcttcgatactgtgttccatcatttctagctcattctgggaaagctctaacttattgataatattctcgtcattctccacaatctttgtcgctgcaaatcgcggagacatgccaatattagctgcatggtcctccacctgatgcgatactgcgtggatacaacggtgcacaggtccctgctcgcagaaatccatgacctttggaagaatctttttcttaccgacctcgacagtggctttgatcagatcttcgattccctcatcctttgctgcactgatcgggattaccgggattccaagttcctccgacatttgcctgtaatcaatagatccaccatttcctctgacctcgtccatcatattcaaagccagaaccattggaatatgcatctctaaaagctgcagcgtcagatatagatttctctcaatattggtggcgtccacaatattgataataccgtccggtttctcattcaggataaaatctcttgtcacgatctcctcattggtatatgggcggattgaataaattcccggcagatccacaacggaacaattctttaccgagcggatctcacctattttctgatctactgtcactcccggaaaatttccaacatgctggttagatccggttaactggttaaataaagtcgtcttaccgcaattctgattgcctgctaatgcaaatatcattcttttgtttcctccatagacacctcaatcttttttgcatcttccttacggatcgtcagttcatagttgcggagtcttatctcgatcggatctcccatcggagctattttttttacaacaacttttgtctttgggatcaggcccatatccagaaaacggcagcgaagcgctccctctcccccaactgtcgtaatgactgcctctgtttcaagtggtaaattgtctaacgtcattttatcctccgtaataaacaggaactctcactggactttcctgtatgattattgataatttttttcagttaatatctcctaactgtccttagtttaatgctcaaattttcctatgtcaatgcagcttacaaagtttttgataatttttctcatttttgtcatttcctacaaaaatggaattttttgcagtcctattatgcacacttttcaattttaaaacataaagtattgagaaagaataagaaaggcaacagaatctatgagaaactgtaatgcacaaaacagaatgaatcctgtctgtccaaacgaatcaaaccgcgatatgagtccggaatttgtcgttgcaatggcatacgttccatggcagcagtttggaccgttatatgatattgaaaaagggcttatggtgggaaccattttccctgaattagataaaccattccttggaaggagggcttttcgaagatgacgaaccaaatgaaccagatgaaccgccaacagctttttaacctcattaataccgtaagcttcgctgttgacgaccttcttctttttttagacacccatccggatgatgcggaagcgatcaaagcattccatcattactcggatatcagacgcaacgctctgcaggcctactctgaccaatatggtccgctgaccatcgacactgcagatccatgcagtcactggaattgggcaacagaaccatggccatgggaaggaggatgtaaataatgtggaattatgaaaaacgactgcagtacccgatcaatatcacaacaccaaatgccaaaattgcacagatcattatgtcccagtatggcggaccagacggtgaaatgggagcatccatgcgttacctctcccagagatacagcatgccggacagacgtgtatgtggcgtgcttacggatattggaacggaagaattagcgcatctggaaatggtcgcatccatcgtccgacagctcaccaaaggcttaagtgcagaagaacttgaagctgccggatttgcaccatattatgtcgaccataccggtggtatctggccacaggcggcgggcggtattccttttaacgcctgcgaatttcagtccaagggtgatgccctcaccgatctttttgaagatatggcggcagaacagaaagcgcgcaccacgtatgacaatattttgaggctggtcaaagaccctgatgtatgtgatccgatccgtttcttaagagagcgtgagatcgtccacttccagcgtttcggtgaagccctgcgcattattcaggatgacctcgacagcaagaatttctatgcattcaacccggagtttgatataccaaactgtcctcgcaattagataaccttaactgttccatcagcttttgcattgcactgactggcgcagaccaaaaagcagaaagactgtcacacaaaatctgctctcatcgagttctttgtatgacagtcttttttatatacactatttattcatgccgatcgaatactcacagtacatattcgatcatgtatgtcttattcgaactttgcaacctgaagcttgcggatcagttcacgcagattctcagcctcactgctcatctcctgactggcagccgcacattcctcggatgttgcggaattcgtctgtacaacgtcattgatctgctcgattccttcattgatctgatggattgctgttgtctgcgtctctaatgtatccgcaatatttccaacctgctctgtgatcgttctggaattatcggctacgtcttctaactgtgttgctgtctgatctgcaatgaccatacctttttctactgctttgacagaagtctcgatcagaactgctgactcttttgctgcctgtgcactctggtcggcaagtactgttacctgatctgctaccaccgcaaatccttttccggcttcgccggctctggctgcctcgatagaagcatttaacgcaagcagatttgtctgggatgcaatctcattgatcgttgcgataatcttatcaatttctttggaagcctcgttgatctcattcatggaatcaaccatctcatgcatcttaccgttgctttctaagattgcatttccaagttctcctacttttccactgatctcttttgcagactgggcgttctgtgccacctgatctgccacgtttgtaacagttgcagtcagttcttccacaactgctgcctgattggtagcgccctcggcaagatcattggagcttgcagccacctgttctgctccttcggacacctcattggatgcactctggatgcccttgactgtctcagccatgctcttttcaaatgccataaaggaatctaagattcctataaaatctcccttccattccacttccggctgcacatcaaaattgccctccgagaacaatttcattgcacgtccgatatcatccacataagatccaagtatgcggatagatttacgcatactatgtgcaagttttccaatctcatcctcagaacgatattctaatgtactgtgcaaattaccctctgtgagttcctttgcaacatcctcgatcgcatgcagtggttcgagaatcgaatcaaccacgacattacttattttcttcacaaaaagaattgcaaatatcacacttaagatgatcaccagaattcctgccactgtcatgcagcctgtaaagatcaccgcctgatggcttgccttgtcagtcactgcatctaactttttcccaatagcgactgcattgtctaatgccggcgtacattggttaataatagcatccgcagcttcctctgtctgtccactcatgatctgttccataatggaatagccgatatttccccaatcagaaagtgcggatgcatattcctgatagagctcgtccgatatgattcctgttgcctttagtgccttcagttctgaatccacctcagcaagctgtgtttctacctgttgctgataactgtcgtaagttgatgtgtcactgtttaatgccatctcacggatatttctcgccgcagaattgacatcgatcctgcagattttcactgcaacatctgcacgttctacattttccacataacgcagcatattccccattaataaacctataacaataagagaaagcacaccggatactatcatcctcaaaatgactcttccgtatccgtaaatgagtctttctttcagctgcattttttcaagtttcttcttcatcctgtgtacccttaatggtataactgccattatttttcccttcgtaatttattttttttaaatattttatcacttttccagaaaataacaatccattctttaaaatttattatttttaattttttcaactgatcatctcatcttagcggtcataccggtttttcatcacggccggcttaaccggtcaacagaatcgagtatatcctggatctgaggtctcatctccggcatttcttccataaactttgccacttccgtgcgctgttcttttaagataccggcattgtattccatccggcttcgaagcttctgtctgcgcatcacaagattatgggtgatctccaccatctccttgtggtcgatcagtgcagctgcctgcggaatccatacccgtgaatcatataaacgatatgcggagagttcccggatcatacggttgttaaaataatcaatatcatcactgttctgttcaaacttctctttctgtttgaccgcatccatatagcattcccagatatattccagttcttttccattgcggacatgatatttttcacatgcataatccactgcatttgtcatattgacatatttgatcttcactttattcaaaagagtgatcgccttatccgcatttgcctttgctctccggctctcggtcctgtcattcatcattttcagatacggaaggcagatgcccagtactgctataaaaataaggatcatccagatgagtctcatatctgtccccagtatgatctgcgtgatcagaagaatcaatgccgcagtcacagacagtcctgctgccacatacatgaacttctgcatttttaccctgtcatgggaaaggatctcctgatataactgccattctcccttctcacgctccaggtatttcatgtcacgcctgatagtctccagataagcctcgttggactgaaggcgtttgatcgcatttggaatatcactctcctcctgctgcatctgtgcaaactgcacatctgcaatttttttctcggaatgcatcagttcatatcgtgttttatttaaagcaacaatattggatgcgatatctgtgatcggctttttttcttcctctgtcagcccttccagagtctggatatcattcagataagaagtgaccactttgtattctgccttttcatcctcgatctctttcgttgtctcgatcatctgctccagacgttcaatgacataatgctccactttatgtggattctccctgtccttttcattcagaatgccttcattcagttcatcaaatttattttccagtgtcttttctttttttcttcttttgaaaaaaaacatatgctcatcccttataatctacaactttttttatacgcttctgaccatttcctgatctgttccataagcggtttattctcctccagctgtccctgtgcatcttttatgagacgttcggcctcactttgcttttttagaatatcctcactttttaaaacagaattccattggtctgacatactcttaaacgcttcatctgaaacatgaaattcttctttgtatttttttaaaatatctgttttttttgccagacggcaggctgccatacacgcagccagtgactctctgttctggttcagccggtatgcattcagaaaattcgccgcagcctcgtcaaataaaaataaccctgcacaggcagttccaagattgtgcctgatattaccctctaagaccggattttttttgcactcctcctccatttcaagcagtttccggtattcatggatcgctttcacatacttttcactctccatgtaacggtctgcccggatcttcgaacattcaaatacagatttattctgcatatccagcagcacagaacggatatggtgtatcgtgtcttctgaacagtatccgcagcttcttaagatcagttccgtaaaatcagaaagacttccatttccgagcaaaacactgcgcagcgactgtgccagatctttttcatcaagttcctgcccgatccagagacagagttcctcactcataaaatctgcctcgatcagatacagatggttttcaatataatagcagagttcctccagcgaatatacattgagtgagatattatcaatatagtatggcatagcagcaattggatggctgcataaaatcaattctcccatcttcccactccctctttacaatgacattgtatattcccatgtcagatccgaactcttcacaatctcgccaaacccaagatcacggattttaatctttaccctggaatcagaaaccggttttgcactgatccggagtcttgtagttttcggcttgcgttccggcagatccgataattccagcttttctatccttgcatccctgctgtgtggcagctgaagccagaaatcaatctccttatctccatccagcagcacctcacagtctccggaagcttcataccagttgtcccccgcattgatcagagacaaaaattcccatttcccacgatttttcactttcaggctgacattcactttcatttcattgtcgcccatatagacatacggccatggatttttctgttcacggacgatcgccgcatagcaggctcccttggaataaaggttcttacctataaatgccctccgtcccttacacatgtaggaaagagacattttcatccagtcaccgtcaaatccatccccgaccagatacacagaggaacagatatgtccatgaaaactgtccagcaggatcttataaaatgactcatctttatggattccgtctaatgcatgtacttcctctgtgatcgttaccatctgtggcactgttcttgtatcacggacggtagcacagcatctcacttcatctccacggcagtcaaacaaaaaaatatcatgcagccataactcctgcttctggttgtatacaaaataataaaaactttcttttctgtcctgtaaaatcaattgactgcgtcctaatccgagatcttctgccacctttccgaacagctccgtcagttctcttgacagggcttccactgtgatcaccaggcagtccggcagtcccggatttcccagacggctcgctaaaagaagcagtttcttgatatagagcgcaaaaagctcctctgcctcatacacgatgttttccacagttacctgtttctttgcaagtgcattgtcaagcagatgaccgatcacatcttcattctggatcaatgccatcttttttgcctcctcaccgataaaccactgtccgatcccccgctttttgatcaacgccaccgggatctggtaaatctcacttcctgcgatcgtactcagtgtttccggctctctcatgccggctttgtaataactgatgacggcattcctgtcgtccatatcgattccaatataataacactgctccgtcatcttatgtgccgtcctttccaatatttttacagcaatttaaaaagcttctttacggtatcgtccatgcttacatactttcgcatgctctctgaaagcattgtctcatcctgcatggcataagcaaacataatattgttgatcacatcataccggctctggtctttatccccatacatattctgatttgaaatctgccggctttccaccactttccactccccatgaagcttctctgaaatataataggacacggattccccaaacaacagcacaaacgccttcacataaataccgtcataaacctccgggatctcttccttatggtattccccaccgtttacactatagtttaacagcacatgctggtctgtctttgtatgatattccacaaaaaacttatcatacagatgatattttctgatcattgtctccccgaactttttgtagaaagcaaaatataaatttcttccagtatacttcatcaaaagttcgtctgctattttgttgtcaactgcatcgagtgcagaaatttcagacaattgctttaacagtccgagcaggcatgcatcatttaatgtctgccccgcaagatagcgctccctgatctgtgaaaatacatgttccggtatcatcatatcattcaccagataataatgggaaaaataagaaaggtacgccatgcagactaattcccttccacccccggcaagataactgtcataaatccgttcgatctcatccacataatctgttgaataaagcatctgcgtaataatacgctcctccagatcaaaggtatcgatctcaaattctctggcagctttccagatagcagccatctgcttggttggtccctgaaaaaatttgcacagataaatcaggatcacatcattatatttttcatgtaaaaaacagttctgtgccattccgagcagataatcattctcctcaaatgaatgttccgtgatctcataactgcacaattccactcctgccctgcttcccagtctgtcatatccatagtggtgtaccagctgaaatgcccgttcaaactgatgtgtctctatgagcatctcctctatataacactgattttcctgcgtcatattacggatatccacttcattcagatatggttctatcacaagcatttcgccttttttctgataaaagcggatgatctccggaatcagataagctttatattcatcactgacacgctccgactgtgtcagcatacgaaaatatcttccgtcttccaccgcaaaatcgtcacatccccttttgccatcgaaataatacaaaagatatgacaattcctccggtgcaagctccatacatttttccagataattttccgggtgaagtaatgcctcatcctgataatcatcggtataacaatttcccccggtatcgcagagaatgactgtgtaatctttggaatatgccttaaaatatccgcatccgttcgtcagtgtaacaacctgtggtgcttttaactgccagtgcaggatgtatgcctttgcgatcccatggttctcacagcataatttatgtacaaataaaacttctgccgctttgtgcgccagttcctcattcaggatgctgacaggaagaatctcctggtatagaatcgccagattgtcatccatatgtccggcttccatctgtgcaagcgcaaactgttccatatttctgcgatatttatggtatacatccggctgtttttcctttgctgcgatgatattcacatataagaccgccatataacggtaggaaagaccactgttatactgaaaatataactggatcatctttgggatcgcagtcacctcattcggatccatagagatcaaaaacgcctcgtacagattcgtgatacggatttcactgtcaattccacgctcataccagacatgatattttggtgcaaactgctgtccacggatcagataagtgcatatcgctgcgaccatctcctctgaaggatctgcctcataacatttctccagaaccggataccattttttctgatattccctctgttccggcaacagattgcgcacctgcaatgcaatatctttcgagatcgcatcctgttttgctgcccaccctaaaatctttaatgtaaaatcatttaatccagataaaaggtatggatcctgccagatcagataatacgcctccaggtacagatatgggctgtggcagcctcgtccgatccactgctcgatcgccttgaatcttctggaactattacggtaaaactcatcttttacaaataaaagaatccaaaacaacatggaatcatccggataatgatgaaaaatctgctcaatctcctccgtcagacgatccacataagactcttcgcgttccatcagtgtacatagatacagatagtatccccagaccggtgtcgtccggtcaagacattcccgtttgtagtctgttaaaatccagcttgcctcctgcttctgccggttgatcaaaagtgcctgcgccttcatcaggcgatgcattggttcttccggctctaaaattgccagatgatccaacagttccacagaactttttgcccatactccggtaacgatccgtttcaaccggtaatcaatataaagctgcataagttctgtccgcgcctgtccggcttccctatgttcagaaacctcccgctcttcctctctctccttactggaagcggtaacggtataaagaaaagactgatccgggagttcaaaacacagtcttccaaaattcttaccggcatgcattgcatctgcatcgatataatactcgtaaaaacaggtacttccgataaaatcattctctgtgatgatctgtttccccggaatcaaaaagtctgcatcagaagaaacgtggatacggacagcgccccactgtggtttctggatctctaactgctctttttgctgttcctgcacaccataaaaacttttctcagtctcttcgaacgtgacctccactttcttcttatgatgggaagcgatcagaaatgtttccacgaccaatgcagattgcggctgcattctcagtccctcatagagaatgcggtctttatcttccctgatcaggtttttgaaattgctggaataaaataaacggtatgcctcatcataattttccttcgcaagcctgcaaaagtcatccagattcttgatttttccaaaggatgaatccgcatacaacctggaaatggacacaacaaaagaaaggttatattccccctggttacatacgataaaaaactcgcctttctgaatatccccttctatcagcccctcactgtgaaactgataccgaatacgcacttcttccccctcaaactgaggtgtaagacattccatacgcggattggaagaataaatgatgccacgcatttttacctgattcgtgctcgtaatgacaaaactgcctgtttcatcctttccttccaatacctctaactctatcttctccgtagacagagatagtttcggaccattgttatcgaattttccatttgcaagctgttgtatccttttccgcaatccgacacctgctcctatctatttttattgcttttttttaagcaatgactataataaattataaactaatttggaggagtaatcaatgataaaacacaaagaccacttccatggaagtgatttagagaaaatagaagaaatctatggaatcaaaaaagaggaaattgtaagtttttcggcaaatgtcaatccgcttggcgtatcccctttgctgcggacaaccttagcagacaagatcgatgccattaccacttatccggacagggaatacacctcgctccgcaaatgcattgccgcatactgtggcactgatcatgaaaatgtgatcgtgggaaacggttctaccgagctgatctcccttttcatccagattgagcatccgaagaaggcaatgatcatcggccctacttattccgagtacgaacgtgagatttctcttggtggtggaacaaccctttattatccactccgggaaaaagccgattttaaactggatgtaaatgatttcatctcacatctgaacgaaaatatcgaccttttagttatctgcaatccaaacaacccgacatcatcctgcatcacaagtgccgatatgcgccatattttagatgcctgcaaagaatacgatatttatgtcatggtcgatgaaacgtatgtggaatttgcagaaaacatggaagagatcgattccgtaccgctgacaaactattacaataacattgtcattctgcgcggaacctcgaagtttttcgcagcaccgggactccgccttggctatgccatcaccggaaaccgtgatctcatcaaggcaatcaacacacgaaagaatccatggacgatcaactcgcttgcagttgttgccggggaaacaatgttttccgatactgcctatatcaaagagacaaaggatctgatcacaaaggaacgtgcccgtatgtatcaggcattttgtgaaagtcctgactacaaggtgtacaaaccaagtgggaattttatgttagtccgtatcctccgcaatgatcttacatcgcaggaactgtttgaccgcgcgatccgtgagaaaatgatgatccgtgactgttccaccttcccattcttagataataagtacattcgtttctgtatcatgaatccggaagataacgacagattgctgcattgtcttttaaataacgaataagcttaacgttccgccagaagctgcttgatcttgtcctgctcgatctcctgctgcatctggcggacttttgcgtcctgctgcaatgcaactaagattctccgtatatcctccggtgaaaacattgcaatcgcttttgacagatcttcgatattgtccctgttcactttcaggcagcctccattctctaactgcactgtaatgacattcttttcatcactcatgtcgccaagtgtgattgcattattctcataatcacagaaaaatgacacgccattataagtgatcactccatcctccgccagataagagtatggagcaatgtcctcaccatctaaatgcttctgtatggttaatttctccgcctgtggctttttatactgctctgccattttcattttctcataaaactgctggatttccttttccttatcgcgtttttcaaaccgctctttctgctcctgctttacctcggtcagatattcatccattttctgaatgatttttttccattcatcctccgtaaaagaattgccgccaattgttgtagaatcctgcgattgtccgttctgtaaccgattctggatttctgtttttcgtttctgcaactctgcaattgcctgtattctggttgtctttgttacatttgccatactcataactctcctccacacccatgtcaaactctgctgtttttacaatatgatgtatttccgatatgcactttaaatctgattttcttttatcaatgccaaaaggacgacatatgattcttttctctctcaaatcatatgccgtcctggtcatttttctcttacatccaatgtactattatatatatcgtatggttttgtgaattcttaagtctctactctaataattccggaatctttttggaacatgcaactgctaacgctcccggtccaatgtgacaggatacacttaaggataacggattcagcacaatctccatacccgggaattctgcctcgacctcttttttgaacgcttccgcatcttccagattatgtgtataagccatctccagatatatattctttccttccggatcattgaaacgatggtcaaagtcattgcgcatggcatcgaccatcattttctttgcctgttttaccgttcttgcctttgcaaaagaatccagcttctcaccctggatctgaagtaccggttttaattttaataaggttccaagcgcagctgcagccggagtgatcctgccgccttttttcagatagtacagcgtgtccaccataatataaatcgaagactccatcttctcacgctcaaggatctctttgattgcctctgcactgtatcctttctctgccaatgcttttgcatccagtacagactgtctctgtgtgactgaaattctctgattattgacaacctgcactctgccgtcataatcctgagagagcatgatagcagtctcacaggaaccactgagcccggaggacattggaatatgcacgatctcgtcatactcctgcagcaattcatcccatgtgtctgtcacatttccgacaagaggcatggaggttgaaatattggcatcttctgaaagtttctgataaaaatcttcctgtgtcagatcaatatcttcataataggtctggtcattaataaaaaatggcattggcataaccgttacgccatattcttttgcttcactctgtgtaattccactgttactgtctgttacaatcgctactttgctcatcctggccttttcctcctataatgtctcagagcgctctttgatgttcttcttaaaattgatcacttcatgttcatactcttcattcataaattcagaatggatcataaaatctgcggacgcacggttatttgcaattggaatatcataaacctgtgcgatacggagcaatgctttcacatccgggtcatgcggctgtgctgtcagtggatcagagaagaataccacaaaatcaattcttccttccacgatctttgcaccaatctgctggtctccaccaagaggaccactgttgtaccctttgactggaagcccggtcttatctgtaatcattcttgctgttgttcctgttccacacaaaaaatgctgtgtcagaatgtccttgttctgctcgcaccattcgatcagatctgcctttttattatcatgcgcgataagcgcgatatttttctttttaccaatggtaagtgtaatgtaattatcgttcatgtatttctccttcgcctgttatttgtgcctgtgttctttcgcaacacgcaaataaattgtatcacaatttttcaaattgcaccacacaaaaatatgcaatacaatatacgctctgcggacattgttactgttcactcgtacctcgttccagtaacaattccctgtaatgccgcaatctttccatcgaggatcattttgataaatgccgtgtcacggatgatccacggatctttttccatcgcaatattcgtgtcgtagatttcctgcggtgtcgcccattttaagtaatatccttttgcgatctcgctctttgtcagatgaatcggtgtttcctccccggtctcctcacaataatagaaaagggaatgacagataaatttttttgtatcgtcaaaaatatcttttcggacttctaaaatctcgccaagtcccactgccttttccggaatgataaatagtccggtttcttccttcacttcccttgctaaagcttccacataggtctctcctgcttccatgccaccgcccgggatcttgtactctccctctttgctgcactgcattgcaatctttccatcccgcacgataatcccacgtatggtatatttttcaaaaacactggtcgtgtctttataattctgtgcatcaaactttttcagaagttccatgtgccaccccttctttcgtatctttgattatgcacattttaccacaccacatatcagtgtgcaatgaagagcacaaaaaagaccatagccaaaagttatcttttcgattcttctggctatggtctttttctcatttatctgattctttcgtcagattttacatcattcccattcccgggttacctgctggcattgcaggagcatcttctttgatgtttgcaacaacagactctgttgtaagtaaagtagatgctacagatgttgcgttctgtaatgcacttcttgtaaccttgaccggatcaaggattccgttttcaaccatatctacatactcttctgtagctgcgttgaaacctgttccaggtgcggactcttttactttattgatgataactgcgccctctaatcctgcatttgcagaaatatagtacagtggagcttccagtgcttttaagattacttttgcacctgtcttctcatcaccctctaaagtatctgctaatttggcaacttctttggaagcatggatatatgcagatccaccacctgcgataataccttcttctacagctgctcttgtagcatttaaagcatcttccatacgaagttttgcttctttcatctctgtctctgtagctgcaccaacacggatcactgctacgccgcctgccatcttggcaagtctttcctgtaatttttctttatcaaactcagatgttgtctcctcgatctgcgcacggatctgtttgattcttccctgaatggcatctttgtcgccggcaccgtcaacgatgattgtattctctttctgaactttaacggattttgcacgaccaagctgatccatggttgtatctttcaattccagaccgagatcagaactgatcacctgaccacctgtaaggattgcaatatcctctaacatagcttttcttctgtcaccataaccaggtgctttgacagctacaacgttaaatgtaccacgtaatttgtttacgatcaaagttgttaatgcttcaccctccacatcctcagcgatgatgagtaattttgcaccgctctggacgatctgctctaacagcggaaggatttcctgaatattgctgatcttcttgtctgtgatcaggatatatggatcatctaatgcagcttccattttatccatatcagaacacatatatgcggataagtaaccacggtcgaactgcataccttctacaagatcaagctctgtctgcatcgtcttggactcttcgattgtgataacaccgtcgttggaaactttttccatagcgtctgctaccatgtttccgacttcctcatcaccagcagaaattgctgcaacttttgcaatctggtctttaccgtttactttggatgacattgctttcaaggattctaccgctttgtcagttgctttcttcataccacggcggaggatgattggattagctcctgcttccagattcttcataccttcctgaatcattgcctgtgccagaaccgttgctgttgttgtaccatcaccggcaacatcatttgtcttggttgcaacttcttttactaactgtgctcccatgttttcgaaagcatcttctaactcgatctcttttgcgatcgtcacaccatcgtttgtgatgagtggagcaccataagatttgtcaagaacaacgtttcttccttttggtcccaatgtaactcttactgtatttgctaatttgtcaacgcctgcgcctaatgctgctctggcttctgatccgtatttaatttcttttgccatgattttctacctctttctattttaatataaataactttttattcaacaactgcaaggatatcattctgtcttacgatgatatactcttcgccgtctaatttcacttctgttcctgcatatttggaataaataactttctgtccctcttttacctgcatggtaacttcttttccatccacgattccgccaggaccaactgcgatcacttctgcttcctgtggtttctcctgtgcactgcttgtaagaataattcctgattttgtagtttcctctgcctcacactgttttaaaactactctgtcactcaatggtactaatttcatgatgattcctccattcaatatatattcttttctttttttcttttgatattgtagaaagttatcagactttctattgttatcatgtgttattagcactcatttagtttgagtgctaaccgatagtcatataatatgtttttcgctctaaattcgcaaccaaatttagaggtatttacatctatattttttcgtgttttctcattatttctctttttttctctcttttttatatcatattattttttcgatgatttcatactttttttagatttatcggtggaaaatagagaattggcttcttccactttctctaaaactgcctgttttacagactttttcaccgtctgatttccggttttccataacatgcgcagtgcctgtgagaaaagctcctgtgtttccggtgaaagcctgctctttgctttcatcagctcctgcacttttttccatttgctgttgtaaaaatcatccaccgtatagattttggcatcatcgagcatggaaaagaccgtatcgacaatctcctcgcgctgttctttcgtcaactggaaaatccattttttcatcgtctcgtcgagcaggatgctctgcggtgcaacctcctccacatagacaaaatggctgccaagcacttcccatgacatggcatcatgctgctggataccactctgggaactttttaccacttcaaacttttcctgatgttcaagcagcatgcctacaatgctggactccggcagaatggtcttgatttttggcagcatccgctggtattccttactctggatcatttcttcgctaaatccaggtccgtcattgctgtacaccttcacgatcctcttctggatattccggtcacatttgacggatgcgtatacggaaagatttccacccttggaatgtcccccgactctgatttttttccaatcctctttcaccatatgattcaggtaatcgacggctttcaactgccccggtgtctcggacagataacccatgttaaagttctcgcgccagcccacaatcgtattgtctgttccgctgaaagatacatagatactcttatcatccaaccggacacataccacagaaaactgggactgttcctctttgctgatgtcgttgatatagccaaacaactgcgcattgcagaaacgctctgtctgtgccatcttctctaacacaaatgctgctgttttcgtcatagacacacgctccatgatctcttttctgtcatgtgccgcaaaaaagaattcacatgcttcttttaccgtgatcgttccctcttcccccggcgccggaacaattcctgcaaattccacatatacaagctgtgccagtatcagattgtccacctcattaaaaggtgcctcccgaaatgtcaggtcaccgcgccagtccagataatccattaaatttgacatattgccctcctagtttttcgaagaaaaatgcaattttatttataaaatttaccctctggtgagcagagggcgtgtcctcccctatatcagtccataatgtttcagtccgtgcaaaataccgtcctcatccacagaacgtgtcacgaactctgcggtatttttcactttatcggttccgtttcccatcgcaatgctgtgtgctacatatgcaagcatctcaaggtcattcgcactgtcgccgaatgcaaacgtattctcatgcggaatttctaacatttcacagactttccgaatgcccgttgccttggaaattcctgccgggtttatctctataattccctgcccatgaatgaccacatcaaaatctgctcccatatcttttacaaactgtctggcatccacagtcggtgcaatgctgctcattttgttgatttgaatctcactgtggtctgtgggaatgtttcgcaaatgttcccccagttctttgcgcagatgtatcacgtaaggatcatctaaaaaatcactttcattcacatacacatactccggtccttctaacacgaccggcatatgatatttttttaacacattcagggcatatgtcacctgcttctcagtcaacagcacctgataggctgtctccttgtgaaaatcaatatgtgccccacaggaagcaaccacaccatcaaatccgatccccaataattccgggctctgtatattcgaacggcttcttccactgcagataaatgcataatgtccattttctctcagtttccggattgcccaaacggcgctttccggtatctgcatctgatagttccataatgtaccatcaatatcaaaaaatactgcctttttcatcctgatttccttttcatttctatttttctgactttgtaattcctttcaagtatatccgatttctctatttttgcatagtaagaaaggctttctctgcaaatctttcctgccatatccaaatttacgctgcatttcccgccgccataacaaaaaaaggctgccaaaccctcgaataacgatacgtcatctaagtttgacaacctctttccttattatgtatgaagtaaattaaatttagttgttgattaatttatcttcttcgttgttccagctgtaaagtttacggatctctttaccaacctgctctgatggatgttcagcagctttccttctcatcgctttgaaatgaacctgacgtcctgctggtgacatatccaataagaagtcttttgcaaaagtaccatcctggatatcggaaagaatctgtttcatagctttcttggtatcctctgtgatgatcttaggtccagtgatgtaatcaccgtactctgctgtgttggaaatagaatatctcattccttcgaaacctgactggtagatcaagtctacgatcagtttcatctcatggatacactcgaagtacgcatttcttgggtcataaccagcttctactaatgtctcgaaaccagcctgcattaatgcacagacaccaccacaaagaactgcctgctcaccaaagaggtctgtctctgtctctgttctgaatgttgtctctaagacaccggctcttgctccaccgataccaagtgcatatgcaagtgcaagatcctgtgcttttccagttgcatcctgctcaacagcgatcagacaaggggttccttttccagcctgatactcagaacgtactgtatgtcccggagcttttggtgcgatcatggtaacatcaacgtctgccggtggaacgatacatccgaaatgaatgttgaatccatgagcgaacattaacatattacctgcctctaagtttggctcgatatctttcttatacatatctgcctgtttctcatcattgatcaggatcatgatgatatctgctttcttagctgcctctgcagttgtatatacttcaaatccctgtttctcagcctttgcccaggatttacttccctcataaagaccaatgataacatggcatccggaatcctttaagtttaatgcatgtgcatgtccctgactaccatatccaatgatagcgattgtctttccatccaataatgagagattacaatcttcctgataaaaaatttttgctgccattttaaatcctccttgtttttccgaaggaaaaatccgaatcccatgatgaggagaggatttgtcctccttgtttttccgaaggaaaaatccgaaccctctggtgaggagaggatttgtcctccttgttttatgtactattattccataatttttacatcggctgttcctctggacagtcctgtaataccggtgcgcgctaactccagtatgtcatatccctgcaacagatccagaaaagcctctagcttgtcctgatgacctgtaagttcaataaccatggaatcatttgtgacgtctacgatcttcccatggaaaatctctgtcacattaagaatcggctggcgttcggtgtcttttgcacgaatcttaaccaaaatgagttctcttgtcactgaagaacccggctccaatttcttgatatcaaccacatcttctaacttggcaagctgcttctcgatctgttctagaatctgctcgtccccacttgctacaatggtaatccttgtataccgcggatcagcagtcaccccggaagaaaagctgtcaatgttatatcctcttcggctgaataatccagaaatatggcttgtaacacccggattgttctcaactaagagagataatacctgtcttctcataatgaaaacctcttccttgtaaagtcttttgcgctttacagttttactcactcatatttaagttaaataatatcaatatcatatttctttgtcaacgtctgagacgatatttgcctatatattttgtgcatatttgtcataacctgtatgactatcttttgtatatttacatgaataataattatagaactgcataccatacccagcctgttcaaacaatagaatgcacgctccgctcttaaagcataacgccggatttttccttgctttcctccagaatatggttcagtttgcggaacggaaccgcaagcacaagaccaacgatcagggagatcaccgtataagacagtaaaattgcaagatctttccaataatcatcccggtacattccggctactgcctctttcattgcacccattgcatacttaaatggctggaactgatagaaaacctggaatacttttggcagtgtctcgatcgggaatgtacatccggctcctgcaacctgaatgaccatgataatgatcgcaataccttcaccgatatttccaaacgccgctgtcaatgcatacattaaaaagccgaacacaaaactacagcaggatgctgccagccagaataaaaacggatgtgcgcactcaatcccgataaagtacagatcacccaataccgtgatcagcgcctgaacctgggcaatcagaaagaatgtgatatatcttccaaaaaactgctgatgcggctttgcattcttaaaggatggttccatctctacttttgtatgtatgatcgcaacaaggatcagtccacctacccagagtgccagcacggtatagaatggcgccatggaagaaccgtaagtgtccacctcgtaaactgcctctgtctcgatctcaaccggggaagccataaaacttccaatctcttccgggtcatgagctaacaatttagataagatctcatatccctcttcccccttcatctggttcagacgctctaaacgtcctccgatcaccccacgcatatccgtgatcgcatcttttgtacccgagagactgatattcgcagatgctaatgttgcagaaagctgtgacagatttccattcgaagtatccaatgcctttgcgatagagccaagcgcattgctgatacctccaaaagtagcagataatccctttgaaattgttccaagggatgccaatcctgttcccgttacattctgcagattgcccattgcactctgtccacttgtgatcgcactcttcatgtccggatatacagctgaaaactgatttgtagtagatgcagcatttcctgataccgacatcagagaatccagcaaattctcatacactgcaagatctgcatctgcttcctctaattttccgatcagcatatcaatgacattggaagatcctgtttcttcttccagaaccgaagaatcaatcagtccatctgaaacttgcatgcagcttttgatcagcgtagagataaactgcgtattgaccgtctgctgaactgcagtttttgctttgtctgtaatctttggagcgatcgcatttttcttttcatttgtgtaataggtgatctcaggatgctccatctcatccgcaagaaaacttaccatgtcttccgtaaaatcttccggcataataagtgcagcataatagtcaccactgtaaacaccatcgattgcttcctctgtcgtgtctgtaaacacccagccaatcgttgtatttgcttccaatccctcgattacagtttcacccatattaaactcggtgtcgtcaatcgtgatccccttgtcgtccgatgcaactgcaactttaatattcgacgttgcatccggtccatacgggctccagttcgataaaatattaaaccatgcatacaagcaaggaagaatcgataagccgatgactataacaaccgctacaacatttgtttttatccttttaaaatccgatataaaaatccgaaaaatgttcaacatatctaatcttccttatcctttttcctgtcttttttcttctctttcttcttaccgtctctgttcccggatatctgttctttggaagatccgtcagaatctttctcctcatctgtctcttcctctttttcttccagcaatgcctcatccggcataatcccagactctccaaaatattttgcaagaattgcgcggtcggcagcgatctttcgttccatctctgctaaccggctgtcaatactgctgtttggaagaagcgtgtcaattttgccatcctctttaattccaagttctgtcagacgctcctgcaatgtataatccatatattccacatagatcagataggcagaaattgtaaacaaagaaacaatccaaagcaccagaaatactactttcgaactgtccatggaaaacatcagcatcaaaaatatcattggaatcagaatgacacaacggattccccaccgtatttttttctggttacgcagatgttcttcattctggtattccatgatcctgcgataagattcttcataatttgtttccattgcatcttctccttacatcattttcgtatcttccatacgctcttccacaaagtgattcatcttcataaatggttttctcacaaacagtccaatgatcagcgctgcaattgcaaacactgccagctggctcatgtacatccagtaatcgttctcatacatgccgccgatcgtctcacgcattgcattgatcgcatatgggaacgggaaatatttgtaaatattctggttaaactgcggcaaaatctcgatcggatatgttccgctggaacctgcgatctggataaccatgacaacaacgacaaatgcctttcccacatctccgaaagaaaccgtcaaagtatagatcaacaggttaaaggtaaaacttgtaaacgcagcaacgatataaaaaagtatcggttctaaacactgtacctttaacagatacagatctcccaggacaacgattgctgcctgcagctgtcccaaaacaaaaaacagtaaaaatcttccaaaatatctctgatatgatctgatgcctgcaaacttttcatcctccacctgcactttgatcagcgcaactaaaataacagcgccaacccagagtgcaagaattgtatagaatggtgtaacagaagaaccgtagttttcaaccggataaactctttctgtattaatcgtaacaggggatgcaaagaactctcccatcacttccggatccgtggacaggatacggatgaactgatcgtatttctccccatcttccacagcattcaattctgataaaatcgtgttcagcttctctttggcagaacttatgatttcttttaaggtagtaaaacttccattggaactgctcactgtgtttccaagactgcccaaagccacaccggtaccttccagtcctttgttcatgctgtttaaagatgcaaccatattgttgtaagcagcagaaatatttgccttcatcgttgcaacatctgcctgtaactgtttttctacgatcggcatgaccgcatcgatcagattggctgccgctttgattgccgcatgatctcctgagacagcattgttaagatcacctatccggttctgcaatactccctgtaccgcagttgttgtctgctcaatgctgtcgagcagtttaatgatatcatccttgttgcttccggcaggaatcagatcactctgtaacagttgttttaacagttcgatctgctgagtggaatttgatacattattcgcagcatttgcaatctcttccgccgttggaagctcttttgataatgttgtattcacttcctgcaaatgggtatgaatactctggtaaacctgatccatctgggactgtaacgttgtaatggtctgctgtgcgtctgtttttgccttgttgacctgtgcaacaccattatttaatttaccggacgcactggaaacctctccgcttgctgtttttaaattagacgcaagggttgcgttgcaggacatcagattatcaattgtcacaagataatcatccagattcttattgacagaatccagtttatcaataattttagtgatatactgtgtcttttgtgcatcatctgcgagttcattcatactttccataacagtggaaactgcaacattcacaaactcttcattaatacttgtctgcagcgttccttttgctgtatccgtaatcttggaagcaattggattcttcttctcattttcataataggtaacagatggatgtaccaggtcattgtccgcaaaaccgtacatgctctcactgaaattctcaccgatgacaattgctgcgtaataatcaccgctgtagacaccgtcgaccgcctcatcctccgtctttacaaactgccagccaatcttgtcattttccttcagattgtcgataacggtatcacccatgaccacaaattcgccatcactcttggtatatcctttatccacagaaacaaccgcaaccggtatcgttcccgtattgctgtaaggatcccaattcgaatagatattaaaccatgcatacagggatggaagtacacagattgcaagcgcaatcaaaagcgcaagcttatttctccacaatcctttcacatcacttttaaaaatcctgaaaatagtcatcattctatcgtactcctgcatttatttctctttttgagttccattattaattataacgtattttatcactgaaacacaaatttttccataaaacagatattattataacgttaaatatatcattttgaaacatacaatttcctttatttgtaattatggaaaagaaaaacagatactgcacggaattcttttctttcctgcagtatctgttttatgtatcattcctgtattctatgatttttattgataataggtaaggtcaaaatatgtaataccattttcgtcatttacctcaaaatcaagatgtctgttgtactcctcatcctgataagaataactgttatattcttcagcttcgtatacatcatcacattctcccatgattgcaaccgctgactgttcgtccattccaatcgtcaatccaccactgaccgacataatcgggaatgcatctacctgatcaaatccataacaggtatccaaagaaaatgcataaatgtcacattctgtaatatcttttgctgaactgtccagatttacaaaaccaatctttactgttacatctggataatccggattttccagttcaattgactcataagtctggtcgcccgcattcatcacataaccatcttcgtaaccataatccgctatatcaaacgtccatccgttcgcctctatctcactgtaggcaaatggcagggaatactcatgtccgtcaaagaaaaatgacatatcctcccatgttccgtccatcggctctgcatctacaaccggtctgtcttcggaagtatctggaagtgtcactgcttcggaatcgtgattgaagatgtcctccgcctgatctccgtcatcatccgctgcataataatcgcttgtcacgcctgtgtctattttattggagccactcgaacttccaccgaccagcgttgaaaccgtcaatgcaataattgtgaagatcaacataattccaaatataataagacccataaataactgtcctcttgcccagtttttgcggattgcgtcttttggattttttccgatcagccagataatatacataacgatatttacaattggaatgttcaccaataaataggtcagcatccactgtccaacactcatctgtggcacaagctcctgctgctgattttccatcccggactgatactgtggctgattgttatagccatatgtattttgcgtaccgccgtaactgttttgtgtacctccatagttgttttcactgccatatgaattctgggtatcaccgtatgtagtctgggggcttccgtaaatgttctggcttgtgccatattcgttctggttattttcgttctgttcgttaaaattttcactcataactctttttctcctccgtgtgtgtattggctaccactttattgtagcaaattgtgaaagtatttgcaacacgaaagtttttaatatcaaattctccttgaatgaaattttaaattccacatctatgctgaatttagtctttctctcttcttagatctatcttatgattttaatatctcctatctgcagtagaaacgaggtatttatgaacaatttaaaaactgctactcaaaaacatatgaccctggatgaccgtatttccattgagaaaggattggatcaacacctgtctctccgttccattgccttacagttaggaaaagatcccaccaccatctccaaggaaatcaaaaagcacaggtctttccaggaacacaatcgttttaatgaacctgctaacaaatgtgctttggcaaaagattgcaaaaagaaaaatatttgtggtacctatgcccctgtttgcaaaaggatgtgcagatcctgcaatcattgcaactctcactgtgaggactttattcctcgatcttaccattgcagtttgctggataaagccccttttgtctgcaatggttgcagtaaaaagaatccctgccgcctcgataaagcctactaccgctcatccactgcacacaggcaatataaaaccatccttgtggaatcaagagcaggtattaacatttcgcctgctgaccttgttgctttggatgaattggtaacccctctcattctgcaggggcagtctccttacatgatcctccgcaatcatccggaaattgctctatctgaaaaaactctttataactacatcgagtccggagctcttagtgtgaaaaatatcgaccttcctaaaaaggtgaaatataaggtgcgttcctgcagttcttctgaagctgccgatctgaccatttatgaaggacgtacttacaaagactaccaggcttttttaaaggaatttcctgacacaagggttacggaaatggatactgtcctgggctgtgaaggttcaaaaaaagtgttacttacccttcactttgattgttgttcccttatgatggcctaccttctcgacagtaaagaggtctgtcatgtaaaagccatttttgactctattgaacgctccttaggaactttttcattttcctctgtattctctttagtcctgacagacagaggtggtgaattccggaatcctgccgcattggaatgcggacaggaaaacctgattcgtacaagcatttattattgcgatcctatgtgttcctggcaaaaacctcattgtgagaaaaaccatgaatatatccgtaaaatatgcccgaaaggcacctcctttgatgactactctcaggaagacatcactctgatgatgagccatatcaacagttctccccggcagagcctgggtggaatgtcacccttgaagcttgcaaaactcatgctgccttcagaggtaatagattactttggacttactgagataccagatgatgagattgtattgacaccggcattattacaaaaatagaaccagacattacatatgaatctgcggataagagtcttgcatattttttcctccaggcaagtggaatttagtcttacagggcacgattccagttgccttatcagtacgcctttttccagtaaatgcacaaacaatgtctggttaaattccactttaaagggtttgacgcatttcgtcaaaccctaaaatatagaatttagtcttctgtatggaatttaagtttacgtgcggaatttactttttcactcaagcaatatcaaattcttaaaatttttgtccaacttttttaatttattttccaataaccctttctgtctgaacccacacgctctatcactgatttttctttcaaagattttaaacgcattgccactgtttttctgctgatttttaatttttccgccaactgtggcatagtataacccgcattttctaataataatgcgagaatctcctgctctttttcagtcaccctatcagttaccctatcagtcaccctttcagttaccttgtaaaattcacctggtccaacctgcaaactcgcaacagattccattggaatcacaatttcaaaaatattatcctccaaaaacacaggtgttccacccgaatataattttgtatacttattggtattcctcataccagagccgagttcatccgcataaccaatttcacgaaatacttttgaaattggtggatttttcggaaaaggttcaaactgattcagtttcaattcaccatgtccgtgaggcaaattgctgtttttagtaaaaattctgttactttcaatcacaaattgtgcagtgtaggcattggaataatcgcgatgtgctaatatattagaaatgatttccctcaatattttatctctggcactgacactctggtcaccatccagcacaaaagaatcattcaaatgcttttttccaaaatccattaatctgcgataactatctattaaatttgtaataataacctctctgtcatcataacgatccatatttttcacacgataaatagcatctgtcttatactgtggtaatacagacataatggtctgatctttaccaaacaacaaaattgccgcaagcgtaattccctcctgaccggtatctggatctgctaaaataagtcctgtgcttctcagaatttcttcttcattcatatttgaccatgggtgattatccacccttgaaaccgccatcttttttgctctttgaatcacatcaaaatcaaggaaatccaatccaagcttcggataaaccttattcacaaaataagtgctctgcttccttgcatacattttgtataccaattccgcattgtctgtaatatcaatatccccttcatgtgtcctgtcccatatacgaccattcaatcgtctaagctgtgttccctctggcacccagatataaatgactgtctttccatttatatcaaatatctgtggtgtaagataaagcggtggatttattttattagcattattaacggacgttgtaaaatccttaagcattttatctgtcttttggggatttacaccccgaatttcttttgtttggtcaactacgccaagaataatatgccctccattacgattattaaaagaacataccgattgatacacatcttttgtcaaatcattctcagacaatttaaattcaacatttatcttttcgccggattcaattatctttttcagctcatttacattcatacccacacctgccttcagactattatttccttctattttttctatataccccatttaattatatcatataaaagaggtctccgggttttcccggagacctgccaaatctttatattattcgaccttttagaacttaccagctttgtgagcttcctcaacacttacagctacagcgacagtagcacctaccattgggttgttacccataccgataagtcccatcatctctacgtgagctggtacggaagaagatcctgcgaactgtgcatcagagtgcatacgtcccattgtatctgtcataccgtaagaagctggacctgcagccatgttatccgggtgaagtgtacgtcctgtaccaccgccggatgctacggagaagtatttcttaccctgctcgatacattctttcttgtatgtacctgctaccggatgctggaaacgtgttgggtttgtagagttacctgtgatagatacacctacattctcatgatgcatgatagcaacaccttcctgaacatcatcagcaccgtaacattttacagttgcacgaagtccgtcagaatatggtttctcatatacaacatttaattttgctgctttgtaatcatactgtgtctcaacaaatgtgaatccgttgatacgggaaatgatctgtgcagcgtcttttcctaaaccgtttaagataactcttaatggtttctgacgtactttgtttgctttctcggcgataccgatcgcaccttcagcagctgcgaaagactcgtgtcctgctaagaaacagaagcactctgtctcttcctctaataacattttaccaaggttaccatgtcctaaacctacttttctgtggtcagcaacagaacctggaatacagaatgcctgaagaccttcaccgattgctgcagcagcatcagcggctctcgtgcatccttttttaattgcgattgctgcacctacagtgtatgcccagcaagcgttctcaaaacagattggctggattttcttaacctgctcgtaaacatcaagtccagcatcttttgtaattttttcagcttcttcgatagagctgataccatagctgtttaatacagcattgatctggtcaattcttctttcatatccttcaaataatgccattttcgttcgtctcctttcctactcttctcttgggtcgatgatcttaacagcatctgctacacgaccatactgtccttttgctttttcccatgctgtgttagggtcatcaccttttttgatgaagtcagtcatttttccaagagaaacgaactgatatccgataacttcattgttctcgtcaagggcgatacctgttacatagccttctgccatctcaaggtaacgaacacctttttcttttgttgcgtacattgtaccaacctgggaacgaagtccttttcctaagtcttcaagaccagcaccgattgctaatccgtcatcagagaatgcactctgtgtacgtccgtaaacaatctgtaagaataattctctcatagctgtgttgatcgcatcacaaactaagtctgtatttaaagcttcaaggattgtttttccctgtaaaacttctgctgccatagctgcagagtgagtcataccggaacatccgatcgtctcaactaaagcttcctcaatgataccattctttacatttaatgaaagcttacaggcaccctgctgtggtgcacaccagcctacaccgtgtgtaaatcctgagatatcttcaatttttttagagtgaacccattttccttcttctggaattggagctggttcatgttttgcgccttttgctactgggcacatgttttcgacttccttagtgtaaatcattttaagtctcctttcacatataaatagatatgtcatctgttaaacattgtcagatgcttaacatacttcaaacattttcgcacatttttttcattttcacaagtagaaaccataaaatttatgtacttttttgtaaaaaagaaaaacataccacaagcaatatatcatttcggaatttttactgcttttctacaatttcatttttatttttataaatagagtttgccggaacaacgccacgcaccatggacagcggataaacattgctgtggcttccgatcacagtacccggattcagaacggaattacatcccacctctacaaaatcaccaagcattgcaccaaacttcttcaagcctgtctcgatttcttccccggttgtcttatcctttactactacaagtgtcttgtctgatttcacatttgaggtaatagaacctgcacccatatgggatttgtatcccagaatagaatctcctacataattatagtgtggcacctgtacagaattgaaaataatatcgtttttcaactcggtagagtttccgacaacagagccttttccgacaatagcacttcctcttacaaatgcgcagtgacgaacctctgcctcctcatcaatgatgagcggtccatttaagcaggcagtcggtgcaacctttgcacttttggcaacccagatgtcctcgccgcgtttttcaaacttttcaggatctaatgtcggtcctaattttttgataaattcactgattccttttaatgcttcccacggataagtaaactgctctaaatattctttcgcaattgtctcattcagatcatacaaattactgatttttgcgttttccattttttcttccttcctgtttttcatgcaaagagccacagctctgctgtgactccttttcttatattattattcttattattcttattattcttttatttctgttctcttaatttgaactgttttacaaggttatcgagcgtttctgcctgtgcagacaattcttcgctggtagcagatgtttcctgtgccatagcagagttggactgaacaacttcggaaatctggttgactccctgttctgcctgctccatagccgttgcctgagactgtgagctctcacttaaggacttggatgtatctgcaatagcattaattcctttgatcacttcgtctaatgtctctgaaaccaaagcaaccgctttatttccatcttcaacgtcatggatagaaccctcgatcagttctcttgtggaaactgccgaagccgcactctgttctgcaagtttacggatctggtcagcaacaactgcaaatccctttcctgcctcacctgcacgtgctgcctcgatggaagcattcaaagataacaggtttgtctggcttgcgatatcctccagttcggaaatgatattctcaatcttcatggaagactcgctgatacgctgcatagcttccaccattgcgtgcatctgctcacggctgtgatgcgcatcatctgcatattttcttgcatcagcatgggacttttgaagatccgctgctgtgtgttctacgttggcagtgatatcagcaatggttgcctgaagctcttcgactgccccggcctgttccgtagcaccttctgccagagactgtgcagcctctgccatattgcctgatcccatggatacctgttctgccgtctcctctacctggtggagagaatcattgatcttgcggttcatgttgcgtattccaataagaagatcattgaattttccggtgtatctttcttcatgatctgttgcgatagcaaaattaccatctgccatctcatttaaaagacttccgctgtcagagatgatcacattcaggttgtctgccatctgtcttgccgtttcaatcatttctgcaacttcgtccttcgcatcatgctccgggaactcgctgtcaagatctccttccgcaaatgttttcaggcgttctgacatctgctgcaacggctttgcgattccatctgcgatctgatttcccaatcttctgccactcaaaacggaaagaattatcactgcgataatgatgatcacaacaataatctccatcactgccaggattgcttctgtctgatctcccttctggacattgacatccatcagatctttcagatcattgtaaacagcctcatacattggcttgagttctttgaccgcccgatcctgcgcttccttgctgccggcttcatctgtcgtggctccgatttcgatcagttcatcggaaagttcccaatatccatccagatcggcaaggagctgattgtacgcatctcttccggcttttgtcaccatgctcttttcgacttctgcaaggtatgtattaaatgaatcctgttttacgtaataatcctcttttaattctttgataatactttcctcgtcataaccgaccgcacccctcagatcactcctcgcaccggcgaacactgtcatcgccttcccgatatctccctgggagaatccataattggtaagcgcattgttatacatccttgtcataattaataacgcaccgattcctacgattgctgagatacttgcaataaaaataacatgcatgtaactcttagaaagcttttctcgaatttttaaatcatgaccctttttcatccctatgtctccttagtatttatttttgtacgcacatgtctcaatgtaccgtaccactgtatataagcataaccctgtacccgacaaaaatcaataaattttgtcaatttttttacattttatttacgcttcaaacatagtttgtttttcctgattctgtgcgctttcagctggctttgcattttccaacaccacgttttctcccggattatcaaaatcaaaactgattctgtcgtcctcaaatttcaggcaggtatcaaacacattccccgcttttgatgtaaatccggttatttttttcttcgtctttccggtctcaaaaagttcctgcataacggcttcctctaactccacctttgccaccgtatgtgccactttaaatccacattcacactcgtaataccactgggattttttcataaagtgtccacattttggacattttaaggtcgtgtctacaggctttggtttctccggaaaatcgaacgtcacctgtccctccggcgtaagcttcaacggtgcgtcaaacatcatgccggtctttgcgataaaccctttgatgacttccgttctgccacggagcagcagttccttcacctgcgcctcctttaacttcactcctgcgattgttccgatcgcaaatctgcagctttccggattatctttggaataattggcacatccatagccgaacggggtctggatgatctccccgccgcagagcggacatttcacatcctttactttcaccggctccaaatccgtgaaatcgaattttaaacctgtgactttgccaccctcatcgcggtttaatgccactcttgcgtcaaacttttttccggttttcgacttaaatccacggatcgtcccggttcttccatttatcaaaagttctctgacctgtgattctgtcagtgatttttctgccattttaccaatagaaaaacggcagctctccggatcatctttcgaataattcgcacatccgaatccaaatggggtctggatgatctcgcctccacagagcggacagacaacatcttttacttgttttgcttccacatgctcaaaatcaaacttaatgacagtcttaccgttttcatctttttccagacagagacaggcatcaaatttctttccattttttgatttaaagccgcggattgttccggttcttccattcgttatgagttctgtgagctgtgacacattcagacttttctctgcaatttttccgacagagaaatcacaactgtcctctttctcccggtcataatggatacaccggaaaccgtaggctgtcgtcacaatgtcaccaccgcaggacggacacttgatcccttccaccacctgtggttcatttgccgaaaaatcaaaactgatattgatttttccctcctcatccttctgcaaaacaagtgacgccgggaatttcttcttcgatttggagacaaagccatccagaacatctgttcttccttttgtaatcaaatcccggaactcctcctccgaaagatcacgccctgcaatcgttccgatggaaaagccacagccggtgccgtcttttttataattgctgcacccatagccaaacggtgttgttacaagctcagcgccacagaccggacaggcaatgccaagctttttcttcgccgcaatgcctcttgcgccctttccggtcaacggctggatctgtgccacaagccgtgacgtcagattccgttccaccatgttcaacgtctcttttcggatgaaatcctcaagtttttcccggtaatcttccatgatcactgttccgcgcgtgataccgtcaagtcctttttcccacgaagcagtcattttcggattcaaaagtgccgggacggtcatatttacgacttcataaaccatctcgcccaacacctccggcgacaggatctgtgattttttattcaagtgcaggtaaccgatgcgcaccagttttttgatgatctctgcgcgggtggcagaagttccgattccggagcctttgatctgtgcacgcagttcttcatcctcgatcagctgtccggcattttccatcgcaagcaccatcgaaccggaagtgtagcgtttcggtggcttcgtgcttccctcttttagagaataaccattgaccggcagttcctgccccttagtcaactgatctgccagttccagaagccccggactatccgtctcctcattatcctctttgttgctgccttctttttcttcttcctgttttcttcctgcaatctctaaaaatcccggcgcctttaatgcttttgcaccggcaaaaagtttttcctctccgacggccaccacaagttttaccgtctgatattctgctgccggataaaaaatacttaagaaacggcggacgatcagatcatacacacttctctgcagttcatttaaagaacgcagctctgtgagctgtccggtcggaataatcgcatagtgatcggtaattttcgagtcatccgtatactgggtcttcgcaatgttgtaatgaagtccttccttcatgatacgctccacatacccctgcaccggctcatagcctttcagtctgctgatattttttccgatttcttttgccactgccgttgagagaacacgcgcatccgttcttggataggtcgtcagcttcttctcgtagagatcctgtgcaacctgcaatgtctcatccggactgattttaaagcgcttcgaacactccgcctgcagttctgcgaggttaaaaagaagcggtgctttctttctggaagttccacgctcaatagattccacaaccgctgttttcccggaaagttcctgtattaagttttccgcagactcctgctttttaaatccgttttccttatacaataatggagattcaaagtatttagaaccttctaccgctttccactccgcctcgatgttcgcatccgtgaaacttccgactacacggtaaaatggtgtttccacaaaattgcggatctcacgctctcttatcacgaccataccgagcacgcaggtcatgacacgtccgactgcaattgcagtatagcttctcgtccctgccgcatcatttaaaagatttccatatttcacagacattgcacgggaaaaattgattcccatcgcgtaatcctcaatggtcctcataatgccggattttccgaggtttgcataatccgacatcggctttgcttcgcggataccccgcttgatttcctcttctgtctgggaatcgatccagacgcgcagctctttcatcccctcgcggacaccgccgtacatacggatgttttcctcaatggtctgtccttcttttccggcatcccctgcccagtagacagtatcaatatcttcgcggtgcagcattttatgtactacatcatactgtttgctgaccgccgggatcacatcatatttgtactcttttggaaggaaaggaagatcctctaacttccattttttatacttttcatcatatacctcgggataaaccatctccacaagatgaccgacacaccaggtaatgacgtaatcactattttctatgtatccgtcatctctgcctgatacaccaagaatccgtgcgaactcctgcgcaacacttggtttctccgttataattaattttttatgagtcatatattatgttgagtcagatgactctttcctttctttattagttttacaacgacaattactcaacattttctttcctttttgatatggttattaatgtaacaacccatttatagcaagaaaggagaagagaatggaaggactcaataaggtttttacatcagaattgcaaacctatgtttctgaattaaaggaggtgatgtttcaaaagggatatagcgattgtcaagtacagacctacaataaaacttggcaatctatattgtcttatgcttcagttcagcccaatcaagaattcacagagggttttcgtcaacaattccttcaggatgtatgtgccgaagctttagaaaaacgtgattctatgtatcgcatcacacgagctgtgaacatgctttcagattttacacaatttcacgttatcttccgtcagtattgtacaccatcaacagatttttcggaagagttacatgatcttttttcggaattcttaaaagctgaggagcatagacatttttccgaaagcaccatgaaacagctacgtggaaggcttatgcgatttcatgattatctttatgatattgggattcgagattttaagtctgtaacaggctctattataaacacttatattttatcacttgcaagatattctacaacttatgtctctgaatcactacgcgaaattcgcaggctactaacttttggatatgaaaatggatttattgacactccgctttcggatttcatccctcacgtaaaaaacatccgccaacagaaaatccccagcacatttaccgacacagaaattgaaaaaatacttaattctgtggatcgttcaaatcctatcggtaaacgaaattatgccatttttctgattgcagcaagattaggaattagaagtagcgatatccgaactttgacattttcaaacattaactgggacgataaactcatctcgttttgtcagcaaaaaactgggcacgcactttctttgccactaccagatgacgtgggctgggctatcatagattatttaaaaaatgggcgtccagaaactaatgttaaaaacatttttgtgtctcatatgtatccttatggagaattacattctcttggtaatgttattccacgacagatgcgaacagcaggtatcaatactcccgctaataaacgtactggaatgcacgcgtttcgacacggtttggctaccagaatgcttgaaaatgatgtttctctccctgttatatcacaaacacttggacatgcagatatctcaagcacagaagtttacttgagaatcagtataaagcaacttgccctgtgtggattggaggtggacttatgaagaaaagaacagttggatcttttgatggaccatttgctcccatgttggatttgtttgtaaagcaaaagcaggcactaggatatgattatgtgggtggatataacgcattacatgtatttgatacattcagcaaacgatatgaagtgaaaaattacgaattgtcgaaagaaattgttctggcttggtcacaaaaacggccgaatgaaaatgatactacaagatcagcgaggattatgtatcttcaacactttgctatatttttaaacagccaaggctactccggctatatagccccaccgcaaaaatatcatttttcacaacatacggcatatgtattcaccaaagcagagattaagaaactatttatttctttagatcaaatggaatatactccaaattctccatactgccatctctcgtttccgcttttataccggatgctttatggatgcggtttccgcatatcggagcttcttaatcttacagttggcgatgttgatatcgaacgtggaattattcatattcatgattccaaaaacggaaatgaacgactcgttccaatggcagcaacactagcagctcgatgcagaacatatacagaatctgttcacaatgatcatgaagaagactttccattcttcttcaaaaaagacggaaccggatattgtgtaagtaatatagaacgacattttcgcgaacaactatggttagcaggaatcccatatcttggcaaggaactgggaccacgggttcatgatctacgtcacacatttatatgtcatagattaaaccaatgggcgaaagaaggtgttgaccttactgcgatgcttcctattttgtctaaatacgttggacatacaggcattgcttcgacacagtattatttaaaattaaccgctgaagcttttccagatgtgctagaacaaatggacgagctaaccgggcatgtatttccagaagtcggaggtgtgatgtatgaagaataaaacacctgattttgcatatcacatgaccaaatttttcacagaatacttgccaatacaacgaaatctaagtcctaattcaatagctacgtatcgtgacacatttcggttactgcttttgttttacgatacggaaaaacatataaaaccaaatttgctgacattagatatgcttaatgttcaacaaattgaagattttatgctatggctcaaaaaggaaagaaattgtggggcaagtacctgcaatcaacgattaggcgcattaaaatcatttttcaggtatctgcaattcgcactaccagactgtgccctgcaatgtcaggaaaatttagccatacggccaatgaagcaaccagaacctgggttaaaatatcttactattgacggcataaaattacttcttgaacaaccagatataaaaaccaaatacggtcgccgtgatctggccattcttagtcttatgtacgacactggcgccagagttcaagaaattgcagatattaaaatagttcatattcgttttagcgcacctgcaacaataagaataaccggaaagggagataaaacacgcgttgttccacttctttctagaaccgaggatatattaaagcaatatattaaagattttaaaattgatgcaggtggaaatgatgcatacctgtttcaaaatagaagcgggcaacagctttcacgctttggaattagctacatcttaaccaaatacgcagatatggcgaggaaagttcatcctgaacttattcccgaaaaactttcgcctcactgtatcaggcattcaaaagcaatgcatctattacaggtaaatgtgaatttggtttatattcgcgatctacttggtcatagtagtgtcacgacaacagaaatatatgcgcgagcagatacaacgctcaaacgggaagctctcgaaaaagcaaatcctattaaagacactccggcgatgccgcaatggaatagtgatgatggtttaatggaatggctccgaactctaggaaaataattatcacatgctgacggaaaacattttccgtcagcaacaaatatttatatgaaaggatattatggtataaaattatgaaaaaatatatcattcccgattggatcaagcaatatgaaaatgacgcagcaccgttttccattgaaaaaattgtattgaaaaaatatgaagacgattggacactatttttttacagtaacgatgatactactggtggcatagtgataaatcaatcttccggaacaacaatagctgaactattagactatgccgaacacaatcacatagccatagaatatagtttgtaaagtttatataactagcatttaccctcaatctctaaacgacgttgattaaacacagtatagaaatcacgtgctttatttatatcttctgtaaatgctaatgttaagccattacttttaagaaatttaataatttcgtgaggattatcatacatatcaaaaattttctgtcgcattcgatcacttaaatttttgtggataatgttaaagaaataaggattataatagtcatcgcttttatttttgcttcgaggatgcttagtatgcttaatacgatcactaaattcatggatattttcatagcgcaagtcatccatagttaaggattcaagacgtactgtcaattcctcgaaaaacacagtggtcgaaatacgtccatccctagtaaaattttcaaaaaatgggtataaaagtgacatgtattccccaacatgtgcgcttattaataaagactcaccttttttagttatacgaataggcaaaaaaatcacctctcgttcaccggtttcaaaagtaactgaaatctgacgggacaatcctgcacatttagtatatgcgacgttgatatgatatccgtgtaacataaaatggtattgaatcacatctcgctgttgatgttgatataagtagctaatattgttaaatgcatttgtaaaatcgatcattaaaatcctccataagttcaaattataaattaaattatgttaagaaaggaatccaaaaaactatgaaacaagcaaaaaacgataacaactcaacatattctaaaactcataaaaaattagtttatgttgagctacacataaattaatgactttgccaaaaaaattcctccaacttctgtaattcttacttctttcctaaataagaagttttataattcattcatatcgaccagaatatatctggtatcctcttctgcaagctgtctgatctcttctgaaaaaccttttgctgaaaacagaaagaaatactttgcatcaatttttgcctgcttcatactctttaacaattcttctttcatctccatggtaaattccggctgattccagttacagtatccgacaatattctcccgcacagagttctgtgcaataatgtcgatatttccttcttttccaatccatgttcccatcttactgatcttcattggcagttttccaatcagattcaaaagtcctacatattccatgcatacttccttgaaatagcgttccagatattcgtcgattcccgatgtgatatacgcatcgtagaactgttccggactcatcatataaagttcggaaagatgtggatacacaaaacggaaccagaaattcacataattatccttaatacgatagacaccttttttcgtgttttcccatccacctgtctcaaaagaggtctctttctccacaatatgaaaagttccgagatttttcatgtacacactgatttttgcacgtgaataaccggtttttaaatgaagttcatttaacttatcataaccgcttgcaatataataaagaatcgtctcatacacagacagttcccgcagttctgccgcaatcagctgttctgccgcccggtgcatataaccattccggtttaaaatatttctgcatatattggttttcagatccacgcgctgatcccagtggttgatatagcctgcaacgccgccgataacaccgtaagttctgatacagtcactgacctgatactgtggaaatgcacgtaccacctctaagaaattcaaaggattaatcttaatctttccatcaattcttttgctctgctcaccgagtgttgcaggcatctcctgttccacccatgcaaccgaagaactgcacaaaaggatcaacactggtcccggataaagacgtttcattcttaatttttcaatgctctccataaaagaggcatctttttttgcaatcaattgaaattcatcaatcacaaccacaagttttgacgcatctccacttttgatccggttaaaaaattcgtcatagctgtgctttgtaatattcgtcgaaaacttctgtcggatttctacctccatctgatttctctgttcctgttccgatgcctgtctgctgcgataataaaagtacttcttatttgaaagaaacgccttcaataactgttctttctcagaatctgtccgtccatacaacacatagagctgatttccactcttctcataaattgtctcaagctcttttaaaatggatgtcttcgctaccataagaaacctcccatttctatctgtttgttcgttaccctcaatatagtaaaaattatatcattttttaacttttacgacaacccggttcttgccatataaaaagatacataagaaatgaccggaacagcattttactgttccggtcatttctttacagtccacacatctgtgatacggactttttaaatcgctatgatgttctttcttatttctttgtgatgtaaccctgtgcttttaacagctctgcgcagagcactgcaccacctgctgcacctctgacggtattgtgggataaaccgacaaacttccagtcataaacggtgtcctctctcagacgtccgacagagattcccataccgttctcgaagttgacatccaaggaaatctgtggtctgttgtcctcctctaaatactggatgaactgctttggagcacttggaagatttaattcctgtggaactccactgtagtttctcaatgcttcgatcaactgttctttggttggtttctttttgaattttacaaatacggctgcagtatgtccatttaataccggaacacggatacactggcatgtgataaccggagatgctgcaggaacaatctctttcttctcatcatcaatgtgtccccagatccgaagcggctctttctcggatttttcttcctcaccaccgatgtatggaatgatatttccaaccatttccggccagtctttgaacgtttttcctgctccggaaattgcctgataagtagttgccactacttcgtatggctcaaactctttccatgcggtgagaacaggtgcataagactggatggagcagtttggttttacagcaacgaaaccgcgctttgtgccaagtctttctctctgatatctgatcacttccatatgttccggattgatctccggtacgaccatcggcacatccggtgtccatctgtgtgcactgttgttggatacaaccggtgtctctgtcttagcgtattcttcctcgatctttttgatctcttcttttgtcatgtctactgctgagaaaacaaaatctacttctgccgcaactttttctacttcgttgacgttcatgacaacaatcttttttactgcttccggcattggagtatccattttccaacgatcaccaactgcctcttcatatgtcttaccggcacttcttgggctggctgcaatcgttgtcacctcaaaccatggatgattctccaacagagagataaatctctgtcctaccatacctgttccaccaagaatacctacttttaacttctcactcattgcctaatctcctcgtctttccctgttcgttcgaagaaccgtcccctgttaccctggctcttttcattcatgacaatcgaatatccgcggatcgtacgtcctattgtttgtccgcctatcacgaacagatgtcgttatagtgaatatattatgctatttttctcaaaaaagcaatggtctattttgtaaaaaaatgtcatctttccgggtattctttgtgcattttttacaataacgttttaccgtgttaaagtttcctttttccaatcctctgcaagatatgccttttctgcctcgatcactttctccatggctgcctttcccggcgccccgatcgtcaatcggttattcacgcatgtctccatggaaatctcttcatatatatcttcctcaaataccggacagatagcctttaactcgtctaaactcatatcgtcgatcgcaattccgcgttcaatacagtagagaacgatttttccgataatgccgtgcgcatcacggaatggaacaccatgttttaccagataatctgctgcatcggttgcattggtaaatccgttgtttgcggacagacgcattttacccttattaaacttcatggttgcgagcattccggtaaataatgcaatacatcctttgacggtatccatggcatcaaaagacagttctttgtcctcctgcatgtccttgttgtaggcaagcgggattcccttcatcgtggtaagtaatgacattaaagcgccataaacacgtccggtcttgccgcgcacaagctctgcgatatccgggttcttcttctgaggcataatactgcttccggtactgtaagcatcatcaatctcgacaaactgatattcattggagttccagataatgatctcctcggaaaatctgctcaaatgcatcatgatggttgcacacgcggacaaaaactcgatcaggtaatcgcggtcggaaacaccgtccatactgtttaatgtcggtccataaaagcctaacagttctgcagtatattcacggtccaaaggataggttgttcctgctaatgcaccggaaccgagcggacagtaattcattctctcataaatatcgtgcagtctcagacgatcgcgcttgaacatctcaaaatatgctcccatatggtgcgccagtgtgatcggctgagccttctgcagatgggtaaatcccggcatgatcgtctcggtatttgcctccatgatcttaaggattgtctctaataattcttttaaaagatcatccgtatgtaacagttcgtctcttgtatacaatctcatatcaagtgcaacctgatcgttacggcttcttccggtatgcagtttctttccggtatctccgagacggtcaatcagatttgcctccacaaaactgtggatatcctcgtattctgaagtgatttcaagcttgccgctctccacttcatcgcgtatctcttttaatgtgcggacaatatcgtctctctcctgctctgtcagaatgccctgttttgcgagcattgtcacatgcgcaatactgccttcaatatcctgcttataaaacttccgatcaaatgtaatggacgcattaaaattatagacaagctgatctgtctccttcgtaaaacgtcctccccataactgtgccatggtgttttcctcctttatatagtcctcttattgattcttcagggcaatttccctgtctctctgattttttgaaaaaacacatccgcaataatactgccgatacatgccatactgctcggataattccacagaacgcttgtatccattcttcttcttaaaatcagaatttaaatatgcaatgccgtattcttccgccagggcatctcctatctcattgagcttttctgcattttttaacggactgatggataaagtcgttgtaaaataatccatctgcattttctttgcaagctctgccgcctcccgcagtcttaattcataacacaggaaacagcgttcaccgccctccgggcagtcctcaagtccttttgccatctcataaaaacgctctttctcatatgcaccctccacaaagtggatcggatatttcaccggaagtttttcaataaacttctgctgctctgccacccgcttacgatactcctcctccggataaatattcggattataataaaaaacagtaattttaaaataatttgaaagatattccaggcaataggaactgcacggtgcacagcaactgtgtaaaagcagcgtcggcacacggttttcgcgctcgtttttttcaatggtctgttctaatattttttgatagtttactttgttcatattagcgaatttcaccttaaagtgcaagccaaaagctgttttgccttctcctcccatgtatatttttgtttaaattccacgtaagcattgttctggatatctctgcacagcgcatggtttgtaagaagttccgccgcataatccgacaaagtcctgatgtccttcagtgaatacatgcagacctgctccccgtcttttaaaatccgtttcagatacggattctgatctgtcagaacagcgcaatgattcgccatacctgcaaaaatgcggtcatgtgccccatgattaaaaaatggcgacacatttaacagcacatccgcatgggcgattttctcaaatgacagtccaaacaccaccgctttttccctcgtcacataagcttcgttgcagctttcatacttttcccagccctcgccgactaagcgcaccggtatttttgctctcacaagttcatccaccgccgccttgcggaaataatcgcggataaatgcatccaccggatacattgcattcataaaaagtgcaaacttatcatccggtaattcctcgccgtgcgcctttaaaagttgcccaaatcccgcctccatcggaaggattggatcttcgatgcgcatttcgatcagctctttcatataagaacgcagtggttccggggacagttcgaccatctcgtaaattttgtccggtctgtcatacgttcccatgaaaagaacggtgtctgtctccgtctttttgcctcctgtcactgcctccgtagccccaagcggcatggtaagtgttttctttactctcggatagtatcgttttacatatgcctcctgcgcctcatccagaaaaattccattcagatttttcaggtcagcattcagacagttataatgaaataacggatgatctaaaatataatcaaagaatgggccatccagtttatcaagcaccggtgttccgtcctcctccaccatccttgtgatcgtggaattaaaatctaaaagcagacggtatttctgcccgtaaagcggttgaaacaccgcatccagatcatcgtgttcatcaaattcacacacctgcacatcaaaaccaagattctcaaaggcatctgccatctggtttgcaaaaaaactgctcgactgataacagatctctctcgaactaaatacaatgattttttctttttccgacataacattgattcctttttcagaaaaagactgccgccgggaaattgtttccactgtgcagcagccttctgttttctactctctgataaattttaaagataaaattccaactacataaaccagtgcgcataacaccataaaaaccagttttccgcagatcgcaccagctatgatctgtaccagcacaaccagaccatgcagccagattggaacatcgtgcagacaaaccgcgattcctgcctctaacacaatgatgagacacaccggaaccaccggaatcttaagtgcaagaatgctcaccagaattgctgcaagagcaaccacgatcactccaaaaaggagtagatactgtttattatcctcataaaaagcaagtaccggattctgctgtctgtgtctgaacttcttcttggacttcttcgcattcgtgcgcttgaaatcctccactacaacattctcctgcttattctcattctctgccatttaaaaatcctccaaaaatattgctaaatataaacgtgacctcattatatcaattccctttcaaaagaacaagtaattgtggaaatattcttttttttcctatataatgaggcagaaaataagaaaggcatggttatgaatatgaacaataaaaactgggtttccgtgtggggaaatgccgtatccatcgcagaacaccacccggaagcttacgcaaaatacattacattacgttatcctgtatacattccatttgacggagacactctccgctttacatttgataattactgcggaagcgaggccgttactgtcacaagagccactgtttctgcagccacttcccctgtttatgaaaaaatgccgctcgcctgtccatgcaaaaaggaaacgatctgcgacatcactttttcaaaaaacgagtctgtgaccatggaagctcatcagaccgcagtcagcgacccggtttcatttccggtcaaaaagggaatgacactcaccgtaagtctttattttgctgattttaccttaatgcagtccgctgttcttgtgactggaccactttccaaaggatttttctccctcggcgaccagacacacgccgatgcccttccaatggacacgaccaagaccacaaactggttttattttttaagcaatatcgaactgatgaccgctgaggaaaaccatacagtcatctgctatggtgactccatcaccgccggtgcatggccggactacctcacacttctggcaaggcaaaacccggacaaccacacggcatttatcagacgtgcgaccagcggttcccgtgtactgcgccagtatgagtgcattacctatgattcctatgggttaaaggggacaaatcgctttccacatgagattccgactaccggggctgataccgtgatcatccagcagggaattaacgacattatccatccgatcggcattgaaacaaatccgttccgcccgatgagtgacctgccgactgcaaaggaactgattgacggttaccgctattacatagaggaagcgaagaaattacatttaaaagtctacatgggcactctgctgccgatctttggctggcgcacttacgcaaccttccgcgatgatttgcgcaatgagttgaatgcgtggatccgttctgcgaaagaaatcgacggatgtatcgactttgatctggcactgcgtggaagcgagaatccatccgcattccgggaaggcttcgacagcggcgatcacctgcacccgagcagcaaagcctatcaggcgatggcagaatgtgcatatgaggttttacggaagtaaatgcgtggaatatctcattgtatgttataggaaaagggacgaccatcttacaagtcgtccctcttctacttaaaattaagattgcgaaacttgtcgcacattgttataatatcgacagggaaaccaaagagccgggcggcttaccctcctacttcggaggggtcaaccctccagacgcaagaaaggagggcgttgccaatgtatattacatactctgatttgattcagacaggaatattcatttgcgcccttgtgagtctgtgctataagattttcaaggacaaaagaaaatagccgccactattcccagtagtgacggctgacctcatataaaggttagtaactcattgcttagagggtagccgctcctttggcttccctttctgttttcaatataacacatcaaaaaactttttacaacatcaaaattctttgcccgttttgcaatctccaaaagagagtttcaaatcgcagttcaaattcatttaatcccagtcaacggcatcatggggaactgttccattttttgctatgctcttatctgccctctctatagcttctatttcgtccggaagcggtacattttctggtataaacttaacaacaacattgtaaagcgtttctatatcttcttccgacaccaattcaatgagacctttcaacatttctttggtcattttgcaccttcttgtgtatttgtttgtaatctttgtgtatcataatttcaaaaaaataaaccgactcatggtcgatttatccttagtagcacttttacaggaatctcctttcctgtgtgcaaacatttgttctgattactattgatcccctaaaatctcggaagccttaattttactagagtttcagaaagccaataaggggactcgaacccctgacccacgcattacgaatgcgttgctctaccaactgagccatattggcatgacgaatcagtcacgaaaactattatatcggattttaaaaaaattgcaactatttttttcagaaatttacagaaactctattgacattttatttatagaatataaaatgttttatagtttgtttattattagtaaactttttgtaaccattcagtatttttcaggattggaggcatgcggtatggatattgggaaacgaatgaaagaacttcgtattcaatatggactgacgcagcaggaacttgccgaccgttcggagcttaccaagggatttatctcccagctggaacgcaaccagaacacgccgtcgatcggaacactgctcgatatcattcagtgtctcggaacaacaccggcagaattttttaccgatgaagaaccggaacagatcgtatttaaaaatgaagactttttcacgaaggtgaatgaagacaaacataatatcattgaatgggttgttccaaatgcccagaaagattccatggaacccgtcagattaaccttgaaagcaggtggatcttccgacattatgcagccccattccggtgaagagttcggctacctgatcaagggaaccgtcaaaatatattatggtggaaaaagccatgtgctgcacgccggcgaatccttttacctgaaagccggcaaaaagcattacatagaaaatcccggcagccgcgatgccgtattgatctgggtatctactccaccaagcttttagatcacgattggtaggattcagaaaggaattatgttatgagcaaaaagctaatcaattttgtcgatatttccaagtcttatggaaacaatctggtacttgatgaattaaatttatatatccgcgaaaatgagtttatcacgctcctcggtccatcagggtgtggaaaaacaacaacgctccgtattttaggcggttttgagacgcctgataagggacaggtcatcttcgatggtgtcgacattaccagcctgcctccaaataaaagaaatctgaatactgttttccagaaatatgccttatttccgcacatgtcgattgcggaaaatattgcgtttggattaaaaatcaataaaaagagcaaagaatatatcaacgataaaatcaaatacgcattaaaattagtgaaccttgacggttttgaaaaccgttccatcgactccttaagcggtggccagcagcagcggatcgcaatcgcgcgcgcgatcgtcaacgagccgaaagtgctcctgttagacgaaccactcggtgcactggacttaaaactgcgtcaggatatgcagtacgagctgatccgcctgaaaaacgaacttggaatcactttcgtttacgtcacacatgaccaggaagaagcacttaccatgtccgatacgatcgtcgttatgaatcagggatacatccagcagatcggtacaccggaaatgatctacaatgaacctacgaacgctttcgtcgcagactttatcggtgacagcaatatcatcgatggaactatgatccaggacaaagtcgtggaaatcctcggtgtaaagattccttgtgtcgatgaaggttttggaaataacactccggtggacgttgtgatccgcccggaggatattgagatcgtagaaccggaaaaaggatttatggaaggtgatatcacctctgtgatcttcaagggtgtccactatgaaatcgagattgtggcaaacggctttgaatggcttgtccacaccaccctgcttcacaatgtgggggagcatgtcggaatcaatgtcattccattcaacatccagatcatgaacaaaccggaatccgaagatgaggaggcagtggagatcgatgcgtaaatcaggaagacagttattcgccggtccatacctgatatggatcatcggttttatcctccttccgctggcaatgatcatttattatgcattcactacctccggaggaacttttacttttgaaaatgtggctgccatcgcagatcccgtgcatgtcagatccatccttttatccttaaagcttggtacaatctgcacgatagtctgtctgttgttagcttacccgctcgctatgattttaaatggcttaaaaatcaagcagcagaactttgtcgtattcatttttattctgccaatgtggatgaacttcatgctcaggatcttagcatggcgtctgctgttatccaacaacggaattgtcaatgcaatcttccagttttttggatttggcaccgtaaaaatgctcaatacacagactgccgttgtatttggtatggtctacgattttcttccgtttatgatactgccaatttacaactccatggcaagaatcaaaaatgatgtcattgaggcagcaaaagaccttggtgcaagtgacgccatcattttattcaagatcatcattccgctgaccttatccggcattatcagcggcattatcatggtctttgttcctgcactgacctcctttgtcatctctgacctgttaggcggtggaaaggtgcttctgatcggtaacgtgatcgagcaggaatttatgcagggaaccaactggaacttgggctccggtctttccgttgtgttaatgatttttgtcatcgcaagcatggctctcatgaatattttcgataaagacggcggaggtactgcggtatggtaaaaaaagctgcgtcaagaatttatcttgcactcatatttttatttttatatcttccaattttagtgttaatcgtcctgtctttcaacaattccaaatcccgtgttgtatggggtggatttaccttgaaatggtacgcagaatgttttaaaaatgagacgatcacaaatgcttttgtgacaacgatccagatcacactcgccgctgctattatctcaacgctgctcggaacactggcagcaatcggtatcagcgccatgaaaaaaaagaataaagcgatcatgttaggggctactaacattcctcttttaaatgcagatattgtaaccggtatcgcaatgatgcttttatttgtaaaatttatgaacctcggctttgtcacagttttgatcgcacatatcacatttgacattccctacgttatcttaaatgtgcttccaaaattaaatcaggcaaaccgttacacttacgaggctgccttagacctcggtgcgacaccgctctatgcttttttcaggatcacatggcctgagatcaagtccggtgtgttctccggatttttaatggcagtcaccatgtcactggacgatttttcgatcaccttctttacaaaaggtgcgggcgtcaatacactctctaccatgctctacaccgagctccgaaaggggatccgcccggaattatatgctttatcgaccattttatttttgattgccttcctgctccttctcgtgatgaaccaccgttcttcctccgagggaaaaggtgcaaaacaggcaatctaggaggcagctatgaaaaaacgacttgcaatgctctttgcactgtgcctcatgacaggtgttctctcctcctgtggaaaagacaccagttccactgagacaacaaagaaagatgacaatacgcttgtaattttaaattacggaaaatacattgatgaatctgttcttgatcaatttgaaaaagagaccggcattaaggtcaaattagaggaatacgaaagtcctgaggaaatgtataccaagttttctgcaggctccatcaattatgacctcgtctgtacctcagattacatggtggagcgtctgatcaacgaagatcaggtgttagagatcaactttgatgatttcgaatattataaaaatcttgattcatccattattgaagcatcacagatttttgacccggaaaataaatattccatgccttatttttacggtacgctcggtatcctctacaacacgacgatggtatccgacgaggaagtatccacctggaacgttctctgggatgaagcatacaaagactcgatcatcatgcagaactctgtccgcgacagctttaccccggcattaagactatcaggctatgatatcaatacgaccgatgaaaatcagttaaatgatgcccttgatcttctgatccggcagaaaccgctcgtctatgcctattatgtcgatgagaccggagatgaaatggcaatgggaaatgcggcgatggctcttgtttattccggggaagctgcttacgccatggaattaaatgatgacctctcctacagtgtcccggaagaaggctccaacctctggatcgactcctggtttatgccaaaatcctgccataacaccgaatatgcagaaaaatttctggattttctctgccgggaagacattggcatgctaaactttgactatgtttattatgctacgccaaatctcgctgtcaaagaaaatttagatgaggaaacattatccgacacaacgattttcccgacagatgagacgcttgccaattgtgaggtgtataaacaatatgacatcgacacgacaaagttatcgaattatctctggaaaaaattaaagtccgaataataaagtttttcgaaacttttttcttttcctattgtttttccattttatccatgataaagtaaatccacgcagttcccgatgcgtggatttttttataacagatgtttgaatttccagtctgttatctgcatatcgttttatcatccgactgatacggaatgtaattgttttcccagggcatctgccattgggaggatttttatgacatatcaggaattcaaagaaaatgtaacaacagtcattcagaaccggcttggttctaatgtgaaagtgacgattcaggagatcatcaaaaataatgatactcattatgatggtctcacgatcttatccaatcagctgaatatatccccaactatttatctgaacttttattttaaacaatatttaaagggcagatccttagaagagatctgccatgatattttatctgtttatgaggagaacaagccgtccggaaatatcgatatctccttttttacaaactatgagcaggtaaaaaaacgtattgtgtttaaacttatcaattatgaacagaataaaaatttgctgcaaaaaatccctcacataaaaatattagatctcgccatcatcttcaattgtcttgtagatgctgacgagaccggaaatgcaacaatattaatttataaccagcatctgtctctctggaatatcaccaaggacgacctctatcatctcgccatgaaaaacactcctgctctcctcacttatgaactgcgggacatgtcagatgttctgatcgagttaatggccggtgttccctgcaattccatgaaggaagaatttgaatacatggttccaatgtatgtgctctccaacaaaagcaaactgaatggctccggctgtattttttaccacaacctgttgcataatctctgtgaaaaactagaatgcgatctctatattcttccaagcagtattcacgaagtaatcctgattcctgcatacgaccatgattcttatgatgaactcacctctatggtaaaagaagtcaattctacacagttatccaaagaagagattttatccgatcatgtctacttttattcccgtgagactggtcagatttctatgtgatcacttctatgtaactttattcaaaatcggtaagtttttcgtataatgcttcatatttaccggcagaacgattccaggaaaaatcctgcttcattcccctctggatcaatccattccagtctttcttcctgtcacggaaaacagagatggcatagcggattgttccaagcatctcatgggcattgtaatttgcaaaagaaaaaccggttcccgtatgttcatattcgttatacgcttccacggtgtctttcagaccgccagtttcccttacgattggcacggttccatacctcaagctcatcaactgtgataatccacatggttcaaataaggatggcatcagaaaggcatcgcaggatgcgtagatacgatgtgcccgctcctcggaataaccgatcgtagcctgaattttatcaggatatttctgtgcaaaataacggaacatatcctgatactgatcctcacccgttcctaacacagcaagctgcacatcctcggttgccagcaattcatccatgatataagctaccagatcaaatcctttctggcttgtcattctcgatacaataccgatcagcatggtattctctttcaccggaagcccgagctctttctgcagtctggctttattcagcttcttgccttcctgaaaattctgctcattgaagtgattataaatatatccatctttctgtggatcatattcttcgtaatccaatccatttaaaatgccatacagatcattttttctggcacgcagcagtccgtctaagccctctccaccctgttctgttgtgatctcacgggcataagtctcactgacagtcgtcactgcatccgcatagacaatgccaccctttaaataattggcctccccgtaagattccagtttgtccgccgtgaaaatctgttccggcagacctgtgatatccataactgccggaagactccagcgtccctgaaacttcagattatggatggaaaatacaatcctgatccccctgtaataattttcatccccataaagagttttcaagaataccgggatcagacctgtctgccagtcatggcaatggataatatccggacagaaatcaagaaacggcaatgcctctaagattgcttttgaaaaatatgcaaacttctcaatatcctgatacagttcattgtacggcttatctccggcaaaataaaattcattatctacaaaataataggtgataccatcctgttttgcttcaaaaatgccggcatattgtttccgccagcttagattcacataaaaatgacatttaaaatgaagctgtcccttaaaacgttcgtccatgcacagatacttcggtaatatgatacgcacatcatactttttcctgtcaaaatactttggcagggaaccggttacatctgcaaggcctcctgttttgataaaaggaatagcttctgaagcagcaaatagtattttcttcatgttataacccctccaaaccccgaaatacttcgaaatcttaagaatattataactcttttttttcgctctgaaaaggtattaatacattttatattccagccggatacggtctgtgatcaacgcgataaattcagagtttgtcggctttcctttgccattgtgaatggtatagccaaacatctcatcaatcgtatccatcttacctctgctccatgccacctcaattgcatgacggatggcacgctccacgcggcttgaggttgtctggtatttttttgcaatggtcggatataaaatttttgtgatggaatttaacatatccatatcattgaccgacatgacaatggcatcacgcaaatactgataccccttgatatgtgccggaacaccgatctcatgaatgatctcagtcacatctgcctcaagattcttctcgctgacatcctctgccttctcgtaggcattcaccttgcgcggctccgtgctctttcctgtttttgctgtctttgccttcttgatccggttgatcaccatgtcattgtcaaacggcttcataatatagtaatctgcacctaattcaaatgcatcttccgtaattttttcctgaccgattgcactgatcataataaacgtcggatgttttttgattgtcttatcatgattcacacggtctaatactccaagtccatctaattttggcattacaatatcaagcaagacaacatccggttcctttgtcttgatcacattgtaagcctcttccccatctttagcagttccaacgacattgagttcctcatcactctcgatgatagcccccaataaccgcaacattctctcattatcatctgcgattgctacattcagtttctccatgctggtcctcctgctgacttatttcaaacatatgtaaaagccacgtcttcccttttcctggcaaatctttacatgtgttatcagcatactcattttcctctcgtaaattttgtcgaacttcgtcggcaagtgtaccaaaggactttattttacaatttcttttttcattctaccatattctcaataaaaatcccatagcccatggacgaatctgagacaaagacatgtgtcacggcgccgattatttttccatcctgaaggatgggactgccactcattccctgcacaataccgcctgtcatgtctaaaagctgctcatccgtcacccggaatagaattcctttattcgcctctcttccactgtaatcaagactctctatctcaatcgcatactctttcttctctccggtaaaaccacagatgatcgtcgccggtccctgtttaatatcctgcttgtaacagatgttatagtaatctccacgcggcagtgctgcaatatttccatccagttttccataaataccaatgtctgtattttcctcgattgttccaaggcagtcagcactctggtaacggatcattcccgataattcgcccggatttcctttttgtccttttttcactccgatgatctgtgcattgtatacatagccttcacgcatctggatgcgctcgccgacatctccatcgctgacggcatgccctaaagcaccataggttccatcttctttgtaatacgtcaaagttcctattccggcaagatcatcacgcacccatgctcctagcatatacgttccatttttattttgtacgggtgtcacaccaacctcaacctcttctcccttgcggttaattttaagaatttctttttctgcaccgttctgctgtaccaggcgctgcagatcctccttctctgcaaccttctccccattcacacttaatatataatctccggctttcaaaatgttctccgcaggtgcagcttcacttccatccggccgttccacttcactggtaccgatcacgaggacacctcttgtcttcacatagatgccgatcggcatcccgcctgcatagaccgcatctccgtccacaagtacaacttctatatctttcaccggaaaaataccaaacaggcggcaggtgacaatgtaggactgcctcacattggcattatttgtgctttttgctacaggcgagctatcctcctgtatttccattgtcacaggtacctgaaactggtaatcgattgcttcccctgctttcacatatatccgatccggtattgatttttcaaatgtatagaccgcaaataaaaatacgatacaataacctgcatatgcaattccacgaaaaaaacttttgtatctgtccattttttatctcctgcaccccaatgaatatcgggctattttccttgtctccataacaaaaagagtacatatacgctatgtacccttttattatgtgtctctttctttttttcaaactgtctttttcgtgtcaattaatggcattttttctgatgtgcaagttctttcatctctcttgcactctcccggactttctctgtgatctccacaccgccgagcattcttgccagctcgtcaatactctcctccccggaaagacacttgatcttcgataccgtggtcttattttccacagatttttcgatcagataatgtgcatcagccattgcggcgatctgtggtaaatgcgtgatacagatgatctgatgattttttgcaagcacattcattttttccgaaaccatctgcgcggtgcgtccgctgatcccgctgtcgatctcatcgaaaatgagtgtctcgattgcatcctgatctgccaataccgttttgattgcaagcataattctcgaaagttcaccgccggatgcgactttacccaacggttttacgggttctccaggattggtggaaatcaagaactccggatcatctgttccgtttgccgtatagtctgcggtctgtccaaactccatctcgaatttcacatctaaaaagtttaagtctttcaatgcctctgtcacagcacctgtcagtttttttgcatattttttacggattttcgatactttatcacagtatttctttaaatcctgctccgcatctgcaagtttttgcttcaaatttccaatatactggtcaaaatcctgcaattgttgcaatcggccttgttttttctccaattcagacaatatatctgcgatcgtgcttccgtactttgattttaaatgattcagctcatccagacgtttttccatccggtaaaacgtttcatcgtcaaactccgtctcgtcaatataatctgcaagctcacgattaaagtcatttacaaggttatcgatttctaataactgctcttccagcccttttactttttcatcatatgcagacgccgcattcaattcccgcaatgcccttccggtaagttcagatacgttgtcactctgatttccggtatactgataggcggcattcaccgcctccatgatcttctttccgttggagaatttccggtagtcagcctccaatgcctcatcctcgccctcttttaggtctgcctcctcgatctctttgatctcgtattccaaaaatgagatctcccggagccgttcttcctcgtccacatctgccgccttcagttcttccagcagagcacggtaatttttgtaggcttcccttaacttttcctttggatcaaaaatttcttcttttgcataatcatctaagatttcaagatgtttctttttcgacaaaagcgactgatgttcatgctgtccatgaatgtcgatcaaaattgaggcgatctcacgcattttggatgccggaacactctctgcattcacttttgcaacacctctgccgttgacgatcttcctgcttaagatgacttcgtcattctccgggaacacgtccagctctcgtaagagttctttctgtttttcatccgtcacagaaaaaataagctccaccaacgcataatccgcattttcacgaagcatctccttctgtactttttcccctaacgccagattgatagaaccaatgataattgattttcccgcaccggtctcaccggataaaatgtttaacccattcctgaaatcaacctctgtctcgtcaatcaacgccagatttttcacatgtagattctgtaacatatagtctccttctactctccccaaaagtatatgttctaatcttctacaagcttacgcagacgactcatcactgcaatcgtgtcatctacgcttcgcactgcacacattatggtatcatcaccggcaatacagccgacgatctcatgcagatgcatggcatctatcgctgccgcaactgccattgccattccggaaaccgttttgatcaccagaatattctgcgccatatccatagacacaaaagcatcccgaaaaacacgggtatatttttcggaaaggtcttcattcgcctctgtcagggcagcgtacttctgtcgaccattactcatagcaactttcgtaagttttaattcccggatatctctggaaaccgttgcctgtgtcacctgatatccttctttctggagataatcggataactcttcctgtgtctcaatatcatgtttttttatcagttccaacatttttgtctgacgttttgtcttcatttccggtctgacctcctaagctttgtgtttatgtataagctttcatttttttgcgcagtatttccagaaagctcatattgttgagtttacagattcttgttgtggaatccgctttccggatcagaaacttatctccaacctctaatcccacagcattgtccccatcaaagctgacttccactgtctcgtccttctgggaacgtctttcgccaatttcgatcatcacttcgtcttcagcaccgatcacaatacttctggaattcaaattatgcgcattgatcggagtgataatgatcatgcttgccttcggatcgacgatcggtccgcctgcggacatattatagccggtagaccctgtcggcgtggagatgatgattccatctgcacgaaatgtattcagatattccccattgacaaaaacgatcagatttaccactgacagcgcccctgtccggtggatgacgatatcattgagtgccactttgcgctctgtcttctcactctgcttgattccataaccgcaaagcatcatgcgtttctcaacggtataatgttcttccatcagttcatccactgctgcaaaaacatttgactcctccagttcgcaaagatatccgagtgttccaagattgactccgatgagcgccatattttgttccaccagtttggaagcagccctgatcagtgtgccatctccgcctaaaacaagcacacactccgtctcctgcgcaattgcatccgcctcaggcgctgcatgttttgcatcgtctccggtactcgtaaagcactggcagctgccaccttttttttcgatataccctttgatctcattggtcagttttaagtttttatctttgaatgcattggtgataatcaaaaaatgtttcatattatttgtccagttctccatgtgcagcctctaccactgcatgaacatcgacggattcctctctgctgccttcggcttcttttctgatatagacaagatactcaatatttccctcaggtcccttgatcggcgaatactccagatttaaaatgtgaaatccaatctccaccgcatgatcgatcactttgtggatgacttcctcatgaaccgctttatcgcggacaactcctttttttcctaccttttccctgccggcttcaaactgcggtttaataaggcagaccatctcgccattatcgtttaacagctcccttgcaggtcctaatactttggtcagagagataaaggaaacatccactgacgcaaaatcaaggcggtctgcgatatcttccggtttcacataacggatgtttgtcttttccatacagacaacccgttcatcctgccgcagtttccacgcaaactgaccatatcccacgtccacagcataaactttgaccgcgccgttctggagcatacagtccgtaaaaccacctgtggaggctccgatgtccatacagacttttccctctaatgtgataccaaaatgtgtcatggctttttccagtttcaaaccgccacggcttacatactttaaggtgttaccttttacctcaatattggcattcacgtcaaacgtagaaccagccttgtcctcacggttattgtcgacaaatacatttccctccatgatcatcgctttcgctttctctctggatggcgcaagtcctttatttacaagtaaaatatctaatctttctttcattctctccgctctctctgctcattctatccatcatcttagattcatttattctgtcacgttctgatacgcttctatcgtgcgcgctatgatcgtatccgcatccagaccgacttctttccgcaaaagttccacatttccatgttccacgtattcatccggaattgcaatatttacaatgcggatatctttgcagttctcattattataaaactcggtcacatgctctccaaatccaccgctgatcacgttttcctccattgtgacgatcactttatggtgttctgtaatgtacctcaatgcgtcttcatccaacggttttgcaaaacgcgcattgataatgctgcacggatatccttctgctttcaatgcatcccggactgcaaccgcagtttttaccattgatcccaatgcaaataatgcgatcccggattcccggtaaatccattcacactttccaatgctgatcggtgcgcggtactctttcagtccatcatatgcctcacctctcgggtagcgtactgcaaccggtgtaccaaaattcactgcatatttgatcatatcggacagttcccacttattcttcggtgccatgatcgtcatattcggaatggatgacagataggagatatcaaaaataccctgatgtgtctccccatcacttccgactaatccggctctgtcaatggcaaataccaccggcagattctggatacagacatcatgtaaaatctggtcgtaagctctctgtaaaaaagaagaatacaccgcaaaaatcggtttcagcccagccgctgccagccctgccgcaaacgtcactgcatgctgttccgcaatcccaacatcgaaaaaccgctccgggaacatgttatgaaaacgttttaatcctgttccatctgtcattgctgccgtcactgccaccactttttcatcccggtcgccaagctttcgcatgacagttgaaaaaatatcggtataatttgccttcactcttggattcttcggaagccctgtttcaatatcaaacggttctgttccgtggaatcttgcaggatgtctctctgccggtgcataccccgcacctttgtgtgtcatgacatggatcaataccggtccatcgatatgcgaagcctctcttaaaagcttcacaattccatgaagatcgccaccgtccaccggtcctaaatacacgattcccatttcctcaaaaaacattcccggaatcagaagctgtttgatcccactttttgtcttacgtattttagagaccattttttctccgtaaggcattttattcagggaatttaacacatttaatttcagatccagataggcgtctgctgtccggaaaccggcaagatacgaggacagaccgcctacattctctgagatcgacatattattatcatttaaaataataataaaattggatttgagccttgccgcattattgagtgcctcaaacgccattcctccggtcaacgcaccatctccgatcacagagaccactttgtagtcctcccctgtgatctctctcgccagcgcatacccaagtcctgcggaaatcgatgtggagctgtgaccggtatcaaagcagtcacattcgctttctttccgttttgggaaaccgctcattccaccgtacttgcgcagcccgtcaaaaccttcccgtcttccggtcagaagcttgtgcgtgtaagactgatgtcccacatcccatataatcttatcttttggaagattcagtgcaagatgcagtgccatggtcagttcgactacccccagattcgatgccagatgaccgcctgtcactgaaatcttttctattaaaaattcccggatctcagaggcaagaattttcagttcttcgtctgtgagggattttatatcattcggttgatttatcttttctaataccatatctggtacctcgatttcttactttcttacggaaactccaaagtgaatctccgttctttctccgcagagttcttatttttctctggaaattaagtaaagcagcagttcattcaaaaactcattcttcaccaccagcgaatccattcttgccactgcgctgtttgtatacaatgcaacatcttcccttgccttctcaagcccttcgaaggacacataggttgccttgtggttcttctcatcgctgccgatcggttttcctaacacttctaacgtacttgtgacatctaaaatatcgtcctgaatctggaacgccagcccgacttctgtggctgctttctcgatcgtgttctgttcgtttttcgttgcccctgccaaaacagcgccgatgagcatagagctttcgatgagtgctccggttttcaaacggtaaataaaatcaagcttttcttttgtgatgtcgccggaatcctccgactgcacatccacaacctgtcctccgaccataccataaatgcccgcctttgtggcaagaatctgcatggcttttccgatattccggttatccggttccatatcaaacgcctttgcagccgtttcaaatgcataattcaacagtgcatcgcccgcaagaatccccatcgcctcgccatagaccgcgtgtgttgtctttttccctctgcggtactcgtcattgtccatcgccggaagatcatcgtgcaccagagaataggtatgaatcatctccattgccgccataaaaggctcgatcacttttgattttccaccaaacagacgataggtctccgacatcaacatcgggcgaagtctttttccgccggcaagaatactgtaattcattgcctccataatggtcttctgccagccctcttccgccggaagatagcgttttatgatctgttctatctcatctactcttgtctgaatctctgctctaatatccaactctgctgctccttcttccattccagtttgttacaggaactgtttcatcactcgaaatctgccagtgatccgtcggcctgcatcacctgcattttcttctcaacagtgtccagaagtaaattacatgtctttaacttttccacgcctgcctgatacagacgaaaagaatcatccagtgtaacttcaggactttccaattgttttatgattgtctctatctgttcaaatgtctcttccagagaaacattctgcttcgtctgttcttcactcattgtcaaatacctccgtgacatttgccttcagtgttccttttaaaagatgtaccgtaagtggatcccccacttttacggtggaagcatccgtcaccgcctttccggtttcatccgcaacataagagaacccctgactcagcttcttcaaaggggataccccttccatctgacctgttaaaattgcaagtctgtgctttttttccgtaagcacctgctccatctgccggtgtaatttttcctcaaggtctaccgcatatctgcgatgttcatgcagtttgctctccgggcttaagtactgtaacttcgtctgatactggtttactttcaactttgccatatctaacttctgctgcaaagcccggttcatccttgcagtttttgctgaaatctctgccactgccgcctgatgatcaaaaaccgcaagttctgcagctgcagacggtgtcggtgcccttaaatctgccacgaaatctgcgatcgttgtgtccgtctgatgtccgacagcggagataaccggcgtctcgcattcaaagattgcccttgcaacctcctcctcgttaaacgcccacagatcctcgatggaacctccacctcgtccgacaatgatcacatccacgccaagtgcatctaatgcacggataccgtttacaatactgcttaccgcaccttccccctgcacaagcgccggatataaaataagctgcacataaggattccttcttgcggaaatattgcgaatatcctgtacagcagcaccagtcggagctgtgacaatcccaagcctcctgatatatgttgggattctcttcttgtactccggggcaaacatgcccatctcttctaattctttttttaacgcttcaaattttaaatataaattaccagctccatccagttcaatctccctggcatagagctgatactttccatcccgttcatagacttccacagagcctgtcacgatgactttgtcaccctctttcatctgaaaagagagcccccggcggtttcctgcaaacatgatcgcattgatcgtcccagccggatccttcaaagtgaaataaatatgccctgaggaatgatacttgcagttagacacttcgcccttgacactgatgcgctgcatcataaaatcctgggcaaacatatttttgatgtatgtattcacctgtccaactgaataaacattcttcatcatgctaattttgccaatactccatttacaaatgccggtgattcatccgttccatactgttttgcaagttcaacagcctcattgatcgcaacttttaccgggatatcatcctcgtacttcatctcgtatactgcaagacgaatcagagtcagatctacttttcccattcttctggtcttccatccctcggaaacctcattgatcgctgcatcgatctcatcaatcttctctacaatgttgtggaacttgttggaaatgtactctttgtccttctcgctgcactcctccacttcctcaaacatattcatctgctccggcatatcttccacattgtggaactccacacggaaaagcattttaaaaacctgttctcttaatcctcttctggtcattgattgatcctttctgtctcgataatctccattcctttacaaggtaaaaaaaggatgtcgctcggacaccctttattctactacatcgtccataacttgcgttacgttctgcaaaggattatttattattacccatatctacgcttgcaatacgaacattcacgatagatacttccaatcctgtcatattctcaattgctgattttacgcgttcctgaactttcgcagatacttccgggatggagtagccgtaagcaatattcagcgccacatccacattcacaataccgctcaatacttccacgcgaacacccttggaaagattcttcattccaagcttgctgacaagttcattggtaatgttaccagccatggaactgacaccttcgacttctgttgcagccagtcccgcaataattgcaactacttcatctgctatcttcacttctcccaaatgtccatcctttattttaaatgtttttctatcctcagccatcgcttaatgcctcctaagtgatattatgtaactattataacagactattccatttttgaaaacaaaaaatgtattaattttctttccgttctataaagtcacacattccgtcacccggttcggatctgaaatcataggcaatgtgctctccctcaaaggaaacagaaaagcttccctccatatccataaaggaatgaatgtgtgcaatttctgataaaacatctgcaaactcgtctaaaaatgcctctgccgcatccgcatttgcacagtacgtctcctcgattgtctcatccacatataatcttaactcaaattcatctaaatcactctcgttgtcgatctgtgcgcattttatgtatgggtttgcatgattatgcagcacgttttccagataggatgcagaagaaaggatccttgactgcgaaacatcctctgcttccaagtataatttatatttgatttttaatgcgttatctgccatttggggtgtcctcacttttccttggtgtatttctatttttagatcattggaaattttcacaattcattttagttatatatgagttttccaattatctattttaacttattttgcagggaaaagtaaatacattatgacaataaaattttccatggttttgcttacagattggtgttatactctctactataaattatcacaaaaaaaagaggaatttatcatgaatcctatagaatttcatccatttgaaatgcaatttgaagtaccggattccgcagaatccatcgtgtatacaagaagatttcaggcaccgcggcgcctgatcatcttaggctgcggctatgtggcgcaatcgctctgccgctttgcctcccagttggaatttgacatctatgcggcggacgacagaccttcctttgccaatccttatacgatgacaaacgcaaaagaagtgatctgtgacagttttcctgccgcaattgaacaaatacatcctgatgagcaggatttcgttgccattgttacacgtgggcacaaacatgatgcggattgtatccgcaccctttatgccagtggcatcacacctgcttatatggggcttatcggttcgaaaagacgtgttgccggactttttgaaaacctctgcacagaggggattgaccgctcttttctcgatcagatccatacgccgatcggtttagacatcggtgccgtcacaacggatgagattgccatttccattttatccgaactgattctctgccgcagcaggctttcccctgggaagaagaacgggatccttgaacagactaaccttgatcccgttttcttaaacgcactccacacagagggaccaaaagcgatcgccgttgttgtggatcgcaaaggctctactcccgtcaaaaccggtgcgatcatgtgcgtcaatgcgcttggacagtcttttggcacaatcggcggcggctgtggcgagcatgaagtactgcgaaaggccttagaagttctctctgacaaaaaagatacgttcctctccgtcgatatgaccaatgattttgccggggaagaaggcatggtatgcggaggaacgatggatgtgatcattcaatatgtaccggggaaagtggagatttatcccttcacttttcctatttactaacaagtttttcccacggttcatatcctttcatataagaaaattctgcctcatcgcggaatccttctaacagtttttcgcgcaattcgtctgcattccaacgggcatttttcttaaattgcagatgccggtataattttgaacccgaaaaatctccaatactctccacattttcaagcaattgcctgaccacatgaaaagtaccttctacatttttctctgcatatacaacatcaagcatagtggaacactcactatattttcccatctcaaatgtatgggcgagtgcttccattttctctgcgagcactcttccatagtcaaaatctttttctttcaatgccatactaagcagaaatgaaaatgtaacaccaagcgtctggctctgcgagagaagaacttcttctattgttttatatgcttcttcggtttttccctgctctttgtacagacgtgccctgaatatctttttcataggatcatgctccgaaaaatagtttaaatatttttctgctgccacatattcttttttccttaaataaaagccaaacagagaatcggctgcatggtactgtatctcttcgttttcgtcctgtaacaccatctcataccacgcattgatctgttcgtcatattgttccggattcccgcacgctcctgttattcttcctgcgtcaagcattactgcgatctgccagatcagcatattgcagttcggatacttttttgtgatctgcaccgcccattcgtaggtcttttcaaatccttctttctctaatttgtcacccatctgccggataagtgtctcaatctccatgtccgtcagtttttcctgaaaagacaacagtgtgtcgagtgaaatatgcaacagccgggcaatcggtgccaacagttcgatatcgggattcgtgtttccattttcccacttattcacagccggggtagtcacccctaacctttttgccatctcttcctgtgtaagcccacattcttttctgtattttcttattacactgccaatctgcatttgtgtcatctcctcatattataaaaattcaaagttatttttccacaacaatactcttgcttgttactgcgtaaaaagtgtttgcagaagcttctgtaaataaatcataacagaagtttcgaagctgcacaattgaggagttgttaaatgttttttcatttttttaactttggctcaaatttaaagattttataaaaagcaatcttgtatcttctcattgtgctgtgttataatgaattaaagcatattttacaaaatcttcatgacatttttgtcatctatattctaagaacgacagattcgtttttttagaatctgtgtacttcattcgtatctatgctttttgttacccatcaacaattgaaaagcaggagacgatttatggcaaaatgcagagctaatgcaacattgcagtacattaaacgaatatgcacagtatgttgccagagtgcgtcactacgcaacagacatgcccttgaaccaagctgtggagcgtgctgtagacgagtgtatccagaaagggattctgacggaatttcttacccggaatcgaaatgaggtcatcagtatgagtatttttgaatatgataaagaattggaagaaaagaagttacggaaagcagaatatgaatacggattctctgaaggtaagaaaactggatttcagaatgctgcaatggaaactgccagacgcatgctgaaatccaacaaactttctttggaagatattgctgatttttccggtttatccatagacgaaattaaacaactgcaaaacacgaaatcatgaaataattatcatttttcatacagaatcacagcagagatcactactggaatgaacgatatttatcaattttgcgagttcttcaaatactttatctgcatataactccttgatctcatggcggctcatccgggtgacctctgcattgtattcatagtcatacgcattctctcccacaagaatacagaaaaatacttttccctgcatgctgtctgcattattcgggtcgacatttccggtcgtgcctgtgattccgaccgcaatctctgtatgaaggtttttctgagcagtttcagccatcgccctcgcacattgcttagaataaactccgtgctcttttataattttttcgtcaacaccgcataagattttcgttttgttcagataagtgacataacctcccggaaaaactgccgatgccccttccgtatccgtgatcatggatgcaatcaacccggaagtgcagctctccatcgtggaaatcgtggtatttgtgtcgatcagttttcttacgattttatctttttcctgctggttcattttgttcctttccccttgaatttcactataagatgtctaaaatggcttctccaacacgccttacccatctctcttatctcagcagccgcgcgatttcctccttataaggcggaattgtctttttcgtttcaccttctgcgcaaagccacggtgtctctaagatttttggcacatcaaggaaccgctcgtcatgcaccaccttatataaaggatcaaacccgattgttcccgctccaatatttgcgtgacggtctttgtgcgcaccgagaagattcaggctgtcattgatatgaaacactgcaatctggtcaagtcctaaaacctcgtcgaatttttggaaaacgccgtcataatcattgacaaggtcgtatcctgcatcgtttacatgacaggtatcaaagcagacacgcagacggtcttttttgtgaaccccatcgtagatcattttcaattcctcaaaagtgcgtccgatctcgctccctttgccagccattgtttcaagggcaatgaaaacatcatcctcattttcatccaaaaccatatttaacccttttactgcctgtgcaatcccggcttccgctcctgcatccagcgcagaacccggatgtaacaccaggattttgctttgcatcgctgcggtacgcttgatctctttttccaaaaatcccaccgcaagttcaaatgtttccggctttacagtgttggcaagattgatgatatacggtgcatgcacgatgatctcttcaatccctgcctttttcgcatactcccatccggcctcaatattcagttctgaaatctcttttctccttgtattctgcggtgctccggtataaagcattaaaatattggcaccataactttccgcctccttcacggaagcaagaaacatttcctttccagccattcccacatgggaaccaagttttatctgtgacatttttgtactccttttcatcttttactttacataggcgtttgcgaaactcttcataatcttctttaaattgttcaaaattaacaaaattttcgaaaacacgctttcgctacgtgtcgctggtaacggtactaagaagccagtcacaacggttgttgtacctgccttcaagtaccgaccgctccccagtgttttctcaagcttttgttaatttttcacaattcaatttaggtttctatgagtttcgcaattgtctattttactttacactgcggatcaaaaacttgatctccgcaaaatattcccgcagcatattgtttggaagatagaatttcgtcgaatctgctgcaattccacatacatcagagagcccctgtttttgggcgatctgcaaagcacggaacatatgaaaatcattcgtgataatccccacttccgcatcttccggcaaaaatttccggctgtaccgcaggttttcttcagtcgttttcgattgatcttccaacaggatccgttctttgtcaattccattctgcatcagatactgcgccattccatacgcttcggaataaggctcatttttcccctgaccgcccgctactatacagactgtctccggattctcattcagatataaaattgcctcatccagccggtatttcaataccacactcggtttatccgcgtgcacctgtgcacccagcacgatcacatagtccagattatcttctccctgtgcatgcatctggcgaatcaccattccctcaatcacaagaaacgacaggaaaaatataccgcacaatattccaaatatccacctaacgatctgcggtatcctgtcccaaattcccatatgaagcagacctgccagcgcaaagagaatcactgcaatgccaatccatacaataaaaaattttgttccaccggaacctgcaatcgccacaatcagcccataaaccagacaaagcagtcccaaaatcagacagatgttcatatattttttcctcatccttccgcctttccttcttttttctcatacagtaaatgaaactgttttttatccataatgttgagtgtcaccgctaaaacgaccgttgcaacaccaaaagcccccactgcaagccacgctcggtcatatccactgttatcaacgatttttccgatcagaatattgccccaggcagaaaatgcaccgcttaccgtataaatgaacgaattgacacgtccccagtgcgtggacggcatccgtctggtcatatacggctggtttcccagcgtattaaacacttcgccaactgtaaaaataaccatcagcacaaaataaagcggcatgattccctgtacaaaccgatacccggataatcctaaaataatcaggctttctccaatcagaatttttcggacatctattattcttcctgcaaaagtagttataattggtgttgcaatgatcactaccaatgcgtttgtgcttgtcagcatgccaaaaatagcagctccttttgctccgtataatgtttccatgttgagtggcagaagataattaaactgtgcatagaccagcgctccgaaacctgccaccaaagcataaatcaggattggcctgcgttcccataaaatcttaaatacatgctcattctcccgtttttcctcgtactcgctcacttttttcttctctacccgaagctgttttacaaataaaataatcaaaagcgtggaggaaaatgttgcaattccggtaattataaatgccagtcccagatagttttcaaataaaaatccggcaattgtcggggaaagcacaagtcctaaattcattccgagatattgcagactatacgccttttccctgctctcgctgtcactcagatctgcaaccagcgcatcataggatggaccttcaattgtcgcaaacactccggcaagataaaaaagtgcaatgctatatccagacaacggcagcagaccgcagataatataagaaataactgtaaccatatcacagcatacgataatttttttacggttcatcgtatctgccagttttccgccaagcagcagcattggaaactgcaaaatggacattgccattgtgatggtggcaatcgttgtcgcattatatcctaatttatttttcaaaatcaaagtgagaagcggccagatcagggaacccatactggtcacaactctgccaaagaacagaatgtaaatctccttgctcagatttttatattgctgtataaatttcattttccaaactccatcccatttcttttgtaaatccattactttccaaattcccagaaagcaaccgcacttgccgccgctacgtttaaagaatccactccgtggctcattgggatttttactgtatagtcacagtctgccatagtctctgcagccagaccgtctccctcagttcctaaaataattgcaagcttttcttcttcatgtaatttttcatcatcaatacggacagaatcattccgaagtgccatggcaaccgtcttaaatccatactcatgcaataagtccatcccaccctgtggccaggagacatttttattttcaatgtaagtccacggcacctgaaatacagttcccatgctcacgcggattgccctgcggtaaagaggatcactgcacgcagacgtcaacagcaccgcatccatgtttaatgccgccgctgaccggaaaatcgctcctacatttgttggatttacaacattttccaacactgcgatgcgccttgcctttttacagatttcctctgccgaaggcattgcagggcggtgcatggcacacaacattccccttgcaagtttatatcctgtaatctgttctaacacctcaagttttgctgtgtaaaccggtgtgtcttggcattgttttacaatgttttttccgcttgtatccaaatccttttgctccattaatatagagattggttcgcatccaaaatccagcgccctctcgatcactttcggactttctgcaataaaaatccccgatgccggttcataataatgcagtaactgcgcctcatttaagcttgtatacacttgtaactccggcagagtcagatctgcaatctctattatgttacctgtatcttgtgttctatcactttttttcatatctattatcgctttcaattctgttgtttgttatgttctgagggaatgattatgggttacagtttttacatggatcatatccatatgcaatcgcttcctctcttgttcctgtaaattccgcataactttccggtttgattttctctacactgtaacaacccggcttatggaatttatgtgtgttcgtgttcagtacatatgtctgcatttctgcggactgctgtgtttcctcctgctgcacattggtatctgtcgactgttgcgtttcctcctgctgcacacttgtgctggtggactgttttgtttcttcctgcgcactggtatcatttacaattgttccgtccgcagagctttctcctgtcgcataatcaattgacacacccggctgcacattatatgcaaaaacgcagaataaaacgccttctccgttgtcttcaaccgattttccctccatcagcacgcctgccgccagaaggttatcaccctcaaaaaccggcgtcacacgatacataacgtgttgatctgtctctttcacatagtccgctaccatattttcaaaaggaagcattccttctatgttcaaatatctggttccggtaataagatttttttcatttgcattttctcctgtaagctgatatccgatcagatgacagcggttatacaaatattttccatcgacaaaatcatatttcacagtatgccagcctgtcggctttaccgcaccaatattcccacgctcctccgccggcatcagatcctgtcccacactcgccacacagactgtgcatcttccaagcggatccaattctccatacgtctcataagaagcactgctcaactcttcctctgtaaaaaaaggaacgttatcattgactgcaacatatgcctttccatcatatgccggaacggctgcaaaatcaaatgtttctgcgattgtcgttgcattttcctgtgtactctgtgctgattctgtcgttccacatccagaagcaaactgcatcgtcaatgcgagacaaatcaccatcgctagtgctctcatattatttttccattttaaaatttctctgttcttcctcattgtcttactcttacaaaacacttttcgttctgctttttctccttctactctctgcaataaatttcttttgtaattttttcatgtgaaaaaccagaaaactcttctgtttctgtcagtttccattcggctcctatctcaacagaaacatctgctggatatactctgttccagcgatagattataaactgctcaatttgttcgtcatctgtatccaatgtctccaattcctgaaaaacatattctccttctttcgcttcctcttttggattttcactgatttctaaattcgaaacagcttgaaacaacttccggctgtaatcagttatccaaagtttcttttctccaactgtttttctgatatcttccgctactatgcggtcctgcgactgccttctgtgattgaaggcaagtccgttattgtcgtctaagcatatgatgatgtacattgcggtgctccttatatttgtttaatactcaagttctatcatatcgtttttttgttctttttccaatataattttatcattttccactgcttgatacgttccacttgaccactgctgaataaaaatagcacctgacagatttttatttccgtcagatgctatatgaacactacacttttatttcattacactgatttcttttctttcttttaaaacatttgctaatttaaaataaactattattatagtttatcacctcaatattatattctccattttaacagaaaaggaactgccttacgacaattccaattcattaattaaaataaatcactatgcgttccagttctagtaagatataaaattaattcgtcttctatatacttatatactaacaaccaatctggtaatatgtgacattctctatatccttcccagtttccgtgcaaatcgtgatccttatttttctcttctagcttttctccattagcaagttttttgataatctgattaattaactcaatgtcataacctctgcttttgcataattttaaatcttttttaaactttgttgtcggttgtacttcatatttcatccaagaatatcctccatcattttatcaacgtcatcatacgtttttctcacttctggatgattaattaaatactccgtttctgccattgcttttaaggtttcaatattaggtgtttcattcatatctggcttaaatggcaacgcttgttctcttaccgcctgttttgcagccattgtaaagaaagttgtcatatcaagacctaaattagacataagttcctgtaattgagcctttaaagtttcatcaattctcatagttacattcgtatttgccatatatatcaccttcctttaattatattatagttcccattttatccattgtcaatacaatgttataacatcgcacatgtaaatctattatttacatatttccattttacacaatatcacccaacaactcaattacttcgtcaagtttctcactcgtttcttccatattatcaattgcatcttcagaacacattcctctatagctgctctgtaatccttctggcatattatcaaatgcgtcctgttcttcacttaatatagaagataactcaatgttacggtaaaggtattcaaatccacagaaaacgcatatatggatctaaggacagtgctttaaaagctatcggtaagcaatttgaaaataaaattgtcccaagcaaggataaattaaaatggaacgcacaaatgttataaaagttatagggtatacaccaatcttaattgaactgtgtataccctatttttttacgattttgcaaaagttctttgcagttgaattattttcccacaatctcatctgtattaatgaactggaacggtgttgtctggtacacgtaatagttcagccagtttgaatagagaatgtttccatgtgatctccactgcagtctcggtttctgtgtgtcatcatcattcggataataattgacaggcattttgatgtccagacctttatccttatcacgtttgtactccttgtcgagggtaacccggtcatattccggatgtcccatcacaaaaattttacgtccctcatctgcaatggcaaggaacacgccggcttcctctgattctgctaaaatcgtcagttccttcacggcacggatatcctctgcacgcacttcagtatgtctcgaatgcggtgccataaaatagtcatcaaagcctcggacaagcggtactttacggttcatcacatgatgctcatacacaccgaattttttctccggaagcagatatttcttcaaaccgtaatgataatagagccctgcctgcgcaccccagcagagatgtaaggtagaggtggcatgtgtcttgctccactcaaagatctcgcacatttccttccaataatccacctcttcatattccatctgttctaccggcgctccggtaatgatcaggccatcaaaataacgatttttaatgtctgcaaaagtcccataaaacttattcagatgactcattgatgtgttttttgactcatgggaagacactgctacaaacgtcacatctacctgtaacggtgtgtttgaaagcgagcgtaaaagctgaagctccgtatcttcctttaacggcatcaggtttaaaattgcaatgttgattgctctgatatcctgatgtgtcgcacgattttcgtccataacaaatatattttccttttccaatatttcctttgccggcaaatcactctgtgtcttaattggcatatcttcttacaaacccttcctcgcgatcagaatcgctctcctattttcgacagtatatcctgctatatcttccagtacagtaaaaactaaattccaagcatttctttcaactgttcttctgaaataacaggaattccaagttcctgtgctttagtcagcttgcttcctgcattttctcccgcaagcacgtaatctgttttttttgagacggaaccggaagccttccctccatatttttcgatcagctctgacgcttcttttcgtcccaatgttggcagtgtccctgttactacaactgtctttcctgtcagaacagattccaccgtctctgtctcttccgcctgcatattcacgccatactctttcaatcggtctaaaatttcgatatttttctcatccgtaaagaaatttcggatacaaagtgcactcacttctccgatatcgttgacctctgtgagctgttcaacggaagcttcctttaaatgatccatatctttaaaatacttcatgatcgcttttgcggctgcctttcccacgtttggaattccaagtccggtgagaagcttataggcatcgttctcttttgacttttcaatcgcatccaaaagcttatccgtatttttttcttttccgataattccctgatcgatcaattcatcgcgatgtgtctttagtacaaaaacatcagcgacattattaatataccccaaacggacaagttcttcaatataaaccgtaccaaaacctttgatgtccattgcgtcacgccctacaaagttgataatatggcgttctaactgtgccggacagtttggtgatgtacacctaatatccgcagtgtctttctccctctctgtctttgcaccgcaaacagggcagacatccgggatcacaaaccgtttccagtcagaaggtcttttctcttttttcacttccttgatcttgggaatgatctcccccgacttataaactacaattgtatccccaattccgatatccagatcatcaataaaatcctgattgtgcaaagttgccctcgaaacagaagttccgcagaggcgcaccggctcaaacactgccgtcggtgtgattcttccggttcttcctaccgaaagttcaatatttaatagtctggactctttctcctccggcggatatttgtatgcgattgcccagcgcggtactttggatgtttctcccaactgctcacggtcagaaaaacgattgatcttcaccacggcgccgtcaatatcatatgccagatttccgcggttttcaccgattgccgtgatcgcatcccacacttcctccgcggtcgtgcagactttataatcgtcgatgacatggatcccctgttttttcaaaaattcatatccttcggtatgagttgcaaactccatgccacgcacctgctggatattgaaaataaacatggaaagatcccgctctttcgtcaccttgctgtctaactggcggagtgttcccgctgcacagtttcttggattggcaaacactttttttccaagaagttcctgtgtctcatttaccttttcaaatgcagcatttttcatgtatacttcgccacggatttccagatactccggtttgtcctttaacttctgttttacgtctttgatcactttcgcattcgcagtgacatcctcaccgaaattaatgccgtcccctctggtttccgccagtattaattctccgttctcataacgcagtgacatggaaagtccgtcaattttatattccacaacaaattccggatgatctaactgtttctgcatctcctccacgaagttaaatacttcctctttggaaaaaacatcctgaagacttaacattggaacattgtggcgcacaagcacacccgcttctctttttgctgttccaccaacacgctgtgtcggagaatccggcgtgacaagctccgggtgctctttttccaggttcttcagttcctgcatcatcatgtcgtattcataatctgaaatctcaggactgtcctgattataatagcggtcaatatgatattcgagtgttttctttaactcggcaattctctcttctgctgacatttttttcatccatttctacttttttgatttttctttcatgcgctcacttttgggatatttcttcgggatgaccgtctcattggaggaatctttaattaatgataaaagctgtctgtactcctccgttgtaacatcccggtaggttccaaccggcaggtctccaagttcaatattcatgattcttgtacgaacaagtttctccacacgataaccgaaatattcacacatccgtctgatctggcggtttagtccctgtgtcaaaataatcttaaactgtttctttccaatctgttttacatgacattttctggtcattgtattcagttcagcaagcggcactccgtttgccagaccatggataaaactctcggtgactggtctgttgactgtaacaatgtactctttttcatgcatattcccggagcgcatcattttattgacaatatctccgttgttcgtcagtaacagtagcccttctgaatctttatccagacgtccgatcggatagatgcgcttcgggtaattaatataatcgatcacattatttttttcgcgcttttctgcggtacagacaatgccaaccggtttgtgaaacgcaattaagatcatttcctcttcttttgaaactttctttccctgaaacaaaaccgtctgtcctggcagcactcttgcgcctgtttccgcaacttttccatcaatggtaatatttcctagttctacctgacggtctgcctcgcgtctggaacatacccctgcttcgctcaaaaatttattgatacggattccgttttcttccatacttttccttttcctgtcattattccatatgattctattttgtacagcttcaaataactacaaaaacggagacttcaatttgctggaagcctccgtagcattctgttacttttttattttaataaatcggtcttgatataacctgtcttattcttccatgttacttttgtccagccttctgcataactcatcacaaccgttaccttctctccggcataggcaactccgactttgtctgctgtctcgctcatggaagaccggatgtttgttgtgttggagagcatgatcgttgtgccctctgtcaatgcttctgatgccgctgtctcagaagcattctccggtgcttctgctgataaaaattcactcttaatataacctgttgtaccgttgtaatcgacaatactccagtctccttctgtaccggttctggtaagtgccgttcctttttctacagagccaagcttgtctgctgaggtatctgcacctgaccggacatttaccttgtctattgtatatacagtttctgttgtctgttctgccggcgtttcttccgctggaatttcgtctgtcggagtctcctcagcaggagtctctgttgcaggaacctcttccgttgcaggcacttcttctgtactctctgttgcgtctgccacaatggtattacgccactcagtaattgcatttggaatagtcgttgcacagagattcaacaggttctcgtctgttgacaatgcagcttcgtatttctgctggatatcattctgtaattcaatgacatcatcgctgttgtagaagttcgtgataaggttgcggatgcttgtatccaacgcactctcctgtctggacaggttgtactcactgtaaagattatcaatgtaaagacttccatcgtcatttgttctgacatagaagaaataaagccccggtgcaggtgtttccactcccataaacttcacattcaggctgacatttaccatataagaattgctgtcaagcccggactttgtatagcagttaatgtcctgatactgctcaatgtactgactgatcagtgtgatataactctgctcattctgtgtgatcggtgttgccagtgtctgtaatgtgacaagatctccggatgcataagcagtaaagtagctgttgatcagctcattgactgccggaactgcattttcctcatatgcttcttctgtcacaaccgtctcagtaaccgccacgttattatcgtctgcgtttccgattccatttcccgtgaatttcactaaaataagtaaaagcacaacaaacagtgctcctgccacgaaatatctggcattcttttttacaaattctaccattttctgaatatctatgttatttgatttattatcctgattcgttgaagccatttttaccaaacctttctgtcacagacccgaattttgtctgcggtatctattatgaaaaatgtaattgtttcctaatctgcaattacaaaaaattaatctaacaaacatattacataatagcattatctctgtttattgtcaacgaatggcaggcttttccaattcttaatattttatttcagagtaaaaaaaaagatgccactactgacatcttttcactgcgcctggcgggaatcgaacccgcagcgtcggagtcggagtccgatgttttatccattaaactacagccgcatatattcttttatctgtttcacatacagcctatttatcatagcagataaaagcgtaaatttcaagagatttttatgcattcaaatcttttaatatctcagtttccagcttctttttctgctccgctgaaattggcagaataaaaacaccgacttttactgctgtctcgctaacactctgctctatcaaaaagcgcctgtcctcctctgtgacctgtccgctcatgtatgcacgtatcactgcattcaatctcgtaaataaagtgataagttcccgaaaacggttttcttttctcagatagcaatgccccgtccgttgtaattcctgattcatggttgcaatgatctgcatggaaagtttcagctcgcctgtgatgtcggatgcctccatcagaacatccggccgcttttttaacatttccgcaaaatacgtttttgcaccaaaaacatccatagaaatgaagtaactcgcaagctgttctttcatctcgcgtgtctctgccttttctcctaacatgcccactttgcactcataaaccttcagatgatttacgcgcacccacacaagcagcaggaactcggaaataaatccaaacacccgtttgtgataatcgtcctctccattttccagacagatccgcttctgcacctcaaaaaaaatgtgaaacagccattcacagtatgtatcaaaccattttttcgatgtgacgatcatattgccaaaatacgtttccgttccgttcacgagctgtacaaatgtatcgtaatattccgggtagagttcttttatcacctctcctgtcatatcgagagcatgaatattatgatttgtcgcaaaaccataatgataggagttgttcagcaccacccttttggtcgtgatcagatcatagtcctttaaaagctccagatactctgcctctgtaaaaattttctcctgctcattcaaaagataccttctgtagtgacaggttcctacatatttatatgtgtgtacatttttccatatccaatacaatccggtcagttcactgtaataacagttttccgcagaaatgttgtctcccgtgttgtcacagaggtaaccaagatcctctttttcctccctgcccacctgaagcggctggtacattttatcttgtggtacttcaaattttttatgtgtcagtgcaaaaatttttatcttcatgtgaaacacctgtctttaaagcatgttatcgaaaacttccgacactcattttacaccatgttcggtttttatcatagtgtttaattcttttaaaagcgtggctgatttttttaactgctcctgttcctcctcatcgagttcgatcggcacaactgcctccacaccatcttttccgacgattgcaggcatactgatgaccacatcttccataccataaattccgtgcatcatggaagacactgggagaatggactgctcgtttcttatgatacactcgcagattctttttaccgccatcgcaattccgtagtaagttgcctgttttctctgaatgatctcataggcactgtttttcacttcctcataaattttatcctcggattcctcgtgaaaataatgtccgcgcatctcacagaacgcatcgagccgcacaccggaaacgtttgcatttgaccaagctgccagctcgctgtccccgtgttcaccgatgataaacgcatgcacactgcggttgtcgaccttcaaatgttccccgatcagatattttaatcttgccgtgtcaagcaccgttccagaaccaagcactctgttctccgggaaaccggacagttttaacgctgtgtaagtgagaatatccaccggatttgaaacgataagaagcatgccctcgcagtttcgctttgcgatttccgggatgattgttttataaatttccacatttttgtggatgagatcaagcctcgtctcgtccggcttctgatttgcccccgccgtaatgataatgattgccgcatcgacaatgtcatcgtaagttccggcatacagccggatcggccttgcaaacggaagtccatgtgcaatatccatcgcctcaccttccgctttttccctgtttacatcgatcattaccatctcggaaaaaatgccgctctgcattaatgcaaacgcagaggacgaacctacaaatccacagccgatcatggcggcttttcgaatatttaccataataaaatcaccttatcgttgtttataatgtttacgataatttttgagaggtaaatctacgcactgaaatatgagggaatgcaatcaaactttcggagacacgctcccgctacgtgtcgctcgcagcggtactaagaactcacatcctgcattttatttctgataaatcagaataaaacgcagaatctgacttctaagaaccggcggctccacagtgtctccttctcttttgattgcattccctcatatcatatacatattgaaacctctcaaaaatcatcttattcgctactatcatgcccgattcggtgaattttatgtgtcacaacacacaggtttggtatgggttatgacattcgaacatatattcgtttttagtttacagatttcctcaagtttgctataattgatgtaatgtaaaactcgaaactcgtacataatgtagaacgcgtttcgcacaaaccattatgataccaggaggaatctgtatgcgctctctcatttttcatgtcgatgtgaactctgcctttttgagctgggaatcggcgaaacgcctgcgtgataacccggatgcactggatttaagaaccatcaacgccgtaatcggcggcgatgaaaagatgcgccacggagtggtccttgcaaaatctccttctgcgaagaaatacggcattatgaccggcgaaccattatcccatgccagacaaaaatgcccggaacttgtcgttgttccgccggatcatgaactgtacgctgcttcctcccgaaagtttatcgaaattttagaagaggttgccccggtgatcgaacagtgcagtattgatgaggctttctgcgatatgaccggaacggaaaaactctacggcgatcccattgctttcgcaacaaaattaaaagaccggatttataaggagcttggctttaccgtcaatatcggtatctctacaaataagcttttagcaaagatggcatctgattttgagaagccaaaccgtgtgcatactctttttccggaagagatggcagaaaagttctggccactcccggtggaatcgttatacggctgtggaaaaaccactgcaaaaagactgcgctctcttggaatcacaaccatcggcgcacttgcaaaagctgaccgccagatgttactctccaattttaaatcccagggcgattatctgtgggaatccgccaatgggatctcctcctctgccgtgactgcagaatctcctgccaacaagggttatggcaactcggtcactctgccttacgatgtcacagatacagaaaacgcgcaccacattctgttatctctctgtgagactgtgggtgcgcgcatccgttatgataaagcctacatcagcgtggtgcaggttcagattgtggacaatgactttcatcaccgctgtaagcagttatccctgccttctgccactaacgtgaccgaaaagatttatgaggctgcctgcaaggcatttgaccagggctgggatcacgctcccatccggctgctcggtgtctctacgagcaaagcaaccgacgaaagctatgagcagtataatcttttcgatcaggataagtttgagcggttgtccaaattaaattctgctatcgataaaatccgtgataagtatggggatgatgcaatcgtgcgtgcctgttttgcggatacgcataaaaattaagctacaacatcctcaaactgggaattataaaggttcgcatagaaacctcctgctgcgagaagttcctcatgtcttccctgctcaatgatatctccatccttcatgacaagaatcaaatctgcgtcacggatcgtggaaagtctgtgtgcaatgacaaagctggttcttcccttcatcaggttatccattgccttctggatctcaatctcggttcttgtatctaccgaagaagttgcctcatctaaaatcaggatcttattgtctgcaaggattgctcgcgcaatggtcagaagctgtttctgtccctgtgatacattgcttgcatcctcgtttaactccatctgataaccacccggcagcgtcttgatgaaatgatctgctcttgccgccctcgctgctgcgattacttcctcatccgttgcatccagccgtccgtaccggatattttccatgatcgttcccttgaacagccaggtatcctgcaataccattccgaatgcatcacgcagttccctgcggttgaaatccttgatattctgtccgtcgaggcagattgcaccactgtttacgtcgtagaaacgcataagcagttttaccattgtcgtctttccggctccggttggtcctacgatcgcaattttctgtcccggttttacgctggcactgaaatcattgatgatgatctgttctggatcgtatccaaaatgaacatgatcgaatgtcaccgcacctgtaatttttgaaacgtccgccggatgttctacgatctgttcttcttcctcttcctccaaaaactcaaacacacgctcggatgctgcagacatagactgtacctgattgatcacctgcgcgatctgctggatcggctgtgtgaagtttttcacatactggatgaacgcctggatatcaccgatcgtgatcgtgccacggattgcaagcagtccaccagtcagggcaacacaggcataacctaagtttcccacaaacatcatgattggctgcatcataccggacaaaaactgtgatttccatgcggaatcatagagaatatcattcgttttctcgaactcttcaatcgtatctttctcgcggttaaatgccttgatgacgagatgaccaccgtatacctcttccacctgtccattgatgtgtcctaaatactcctgctgcgcacggaaatatttctgtgatttttttgtcacaaatccgatcagacccatggagatcggtaagatcacaagtgcaataagtgtcataagcggtgaaatactgagcatcatcacaagcacgccgatcagtgttgcaacggatgtaatgattgtggtaatactctggttcagtccctgtcccaacgtatctacatcgttggtgatacgggacaatacctcgccgtaagtacggctctcgaagtatttcatcggcatgcggttgattttttctgagatttcttttctgagctggtagcacactttctgtgtgatcccggtcatgatccatccctggataaagttgaaaaccgcactgcacagatacagaccaagcacaaacaaaagaatgcttccaatctttccaaaatcaatgcttccggttccctgaattttcgccatcagaccttccgataatgcagtggtcgcttttcctaaaattttcggtcctgcaacattaaatatggtagaacatgctgcaaaaaacatgacaacaaaaattgcagctttgtattttccgatatagctcatcagctttttgatggattttttgaagtccttcggtttctcgcccggctgcatgccatgtcccatcggtcctcttctccgtggctgatgtgttttaacttcctgttctctactcattcaaagccacctcactttcctcaagtccaagttctttcgcggataactgtgattttgcaatctgccggtaaacttcgcatgattttaacagttcttcatgtgtacccttgccgacaatttttccgtcatcgagcactaaaatctgctctgcatgtaaaatggtactgatacgctgtgccacgatgatcacagtactgtcttttacattctcagcaagcgcttttcgcagcgccgcatcagtctttagatcgagcgcagagaaactgtcatcgaaaataaagattttcggatcttttgcaatcgcccttgcaatcgcaagacgctgtttctgtccaccggaaacattgcttccgccctgcgcgattgcactctcatacttgtcatccttcgcctcgataaactctgttgcctgtgcaatctctgccgctttcttaatctcctcgtctgtcgcatcatcttttccaaaacgaagattcgaagcgatcgttccggagaataaaacacctttctgtggaacgaaaccaatctcatcacgaagatcagacatcgtaatgttacggatatcttttccatcgagtgtaatacttccgtctgtcacatcatataaacgtggaatcagattgaccagtgtggatttaccacaaccggtacttccaatgattgcggtggtctgtcccggttccgctgtaaaatcaatgtcatgaagcacatcttcctccgcacccggatatttgaaattcacatgggagaatttcacaactccattgtgtgttgtcactttttccggctcttttgcgtcatggatcgaggattctgtctgaatgacctcatcaatacggtctgctgcaacggctgcacgaggaagcatgatcgacatcatcgtgagcattaagaatgacataacgatcatcatcgaataagtgataaacgctgtcattgcgccgacctgcatcgttcctgcatcaattttgtgggcacccacccaaacgataccaacggaaagaacattcatgatcatcatcattcccggcatcataaaagtcatgacacggttggtaaacagcattgtttttgtcaggtctttgtttgccacatcaaaacgttcttcctcttttttctccctgccgaaagcacggatgaccgaaagaccggtcagaatctctctggataccagattgatattatccaccagcttctgcatcaactggaactttggcatggcaactgccatcagcaccatcacataaccaaggatcacaaggatcgcaaggacaatgatccatcccattccggctccggtctgcacgacttttaacacaccgccaatgcctaagatcggtgcatacgctaccatacgaagcagcataaccgaaaccatctggatctgctggatatcattcgtgcttcttgtaatcagggaagctgtggaaaatttatccatctccgcattagaaaatccaacaacctgtttaaatactttctctcttaatgttcttccgatgcctgcaccgacacgggaggcaaagaagcccactaaaaccgtcacgattccgatcatcagcgccatgccgaccattttcagtccggctgtgacaagataacttttctgaatcttttccacgtcaattcctgccgctttatcgcaggataccgcataggctgcgcccatggatttcacaagggaacttcccattgtatcaatggtctcttccatgctgtctctcatggaaagtaaggtgtctttttccagagtaccggcatctgccccggtcggttttgcaacatgctcttttactgcagagtcttccatcgcactcatctgataattcataatgagcggaactgccagtgtgtcatcgatctcgtttaattctgatctggatgtcacctgcagccggtaaatatcaccgtctttctcatagatactctcccagagatctgcctcctcatccgtcatgaataactctgccgtttcaaactcatccgcagtcaatgcctccggcactacatgttccacaccatagttctggataccaacatcaatgatatccgatgtgtaagacggtagtgacagatcacaccatgcctgcacaaagagtaacgcaatgataatcacaattgatttccaatatgaaatcatatttttaaaaatcttactcatgttccctttcctttcttctgccttgcccttttctagcttcaatctctttttccgcaatatgataaatgttatccaaataagaaatcaggtgtttcatatctgcctcatccacctgtgacatcacagatttgccgaagtccgccatgatctgccttgcttcctctgtcagacgttctccctctgcagtcagttccacatacgtattccgtctgtcatttttattgatattccgctccacatatccgcgctcttctaacccttttaaagttctggaaatcgcggatggaagcattttcgctctggatgcaagttccgaaatggtaatctttccattctcccctttatccataatcgtacacattacgaaaaaatctgtcctgttgatcatcggaaacatctccgcaaatttcagcttgcggaactgattcatcgcgcggaacagttcttcatataatttatccataattcactcaccacctgctattatttaacattgttatatattgcatgtgtcaaataataacaccggcaaatatctatgtcaagaaatttgccggtgtttccatttattttctcttttgtttatacttatttaataattttatgcattttctccaaaatatcagccacctcatgcatctccatctgacctggtgcactcgcttttttgtgtgccgcaaaagtgaccgctgcgccaaaactctcgccgcacagcctgctgatcatccccatctttcccatggacattgtgatgaccggcgtgtccggattctcttccttaaactcattcgtcacagataaaagttttaaaacatcctccatattctgtggcataactgcaagttttacaatatctgcacctcctgcacacatctgttctaacagcatcttcataacttctctgtccggcgtctcataaaaatcatggtgggaggcaatgactttcaagccctgcttatgaagctttctgatttttcttgccggatgctcctcctcaaaaaattccagatccagaagatccacgcagcctgcctccgccgcaagatcatgcagatcacttaattcatccgatgttagttctcccatgccgccctgctttttggttcggaatgtatataagaaaatcttctctttcatgcactctgccgcagccgcaaacacttcgcgcactgcattataatttttgtaatccgcgaaaacatcaatacgccattccacgacatctgcttcactttttgcaagtgtccgtaattcgtctatgatctcttctttattgctttccataaccggaacgcataaaagtggttttcctgttccaattgtttttcccttaatctccatatgcctgtcctgctccttttctatccatcctaaaccggatttgcgaaactctgcctgatttatgttccacgatcatttctattttaaaacaccagactctaatattcaatgcatgcaatataaatagtattcatggaggctataaaaaattggaacatctgtgaatttgacaatttattcacaatctattagaatgactgttagtataatctactaaaggagagtattacatgagtttcacatttttaaacgaattaccttctcctgcccagatccaagaaagatatcctctgtcagagaaattgcaggagttaaaaaaacagcgtgacgcagagatcagcaatgtgatcaaaggtcttgacaaccgttttcttgtcatcatcggaccttgttctgcagacaacgaagattctgtatgcgattatgtcagccgtctcacttccattcaggaagatgtcaaagacaagctgatcatcatcccacgtgtgtatacaaataaaccacgtaccaccggtgaaggctacaaaggaatcgcttcccagcctgaccctgaaaaagcaccagatatggtggaaggtctgatcgccatgcgcaaaatgcacatccgtgccattgaagaaagcggtctcacctgtgcagacgaaatgctttacccggaaaactggggatatgtagaagacctgctctcctacgttgcgatcggtgcacgttctgttgaagatcagcagcaccgtcttaccgtcagcggttttgatgttgcatccggtatgaaaaatccaaccagcggtgacttttccgttatgttaaactctgtttatgccgcccagcatccacaccattttgtttaccgtggctatgaagtggagacaactggaaatccattaacccacgttgtactccgcggcgccgtaagcaaacacggaaacagcacgcagaactatcattatgaagatctgatccgtctctgtgatatgtatgccaaaatggatcttgtaaacccggctgccattattgatgcaaaccactccaattccggcaagcagttcaaagaacagatccgtattgttaaggaagttatgcataaccgtcagttatcgcaagacatccataacatggtaaaaggtgtgatgattgagagttatattgaagaaggatctcagaagatccacgatcatatttatggaaaatctatcacagatccctgccttggatgggaagattccaaaaaactgatttatgatattgcggagatgtgtaaataaaacatcgctttttattttgttctatagtaaaaaagtctgccgacaggtactacctgccagcagacttttttcatgcaccatacagtgctcatttttcattacagatctgatgaagattattccgcacgggacatagcttcttcgtaatcttttgtgcctttccagatctcatctttgtaaggattcttctttaacttcatagaacgtttgatgatcgcagcgaatacaacaacgttgactacaattgaaagaacagagatcacaccctgtgctgtaggatctactgctgttggatgtgtagctgcatccatgaatccatctgcgtagagccttgggataactgcgaatttaccctgatcctggaataatgggaatacctgggcaaacatacaccataatgctaatgtgttagcacggttctgaatccagccacctttgttccagaatgctgcagcaaatgtaggtgcaagtaataatgcaacaccacaataccaggaatgagtcggaaggtttaagtaagtatactggaagttccatacatcataagctaagatgaacatccatgtcatatccggccataacatatcatcttttttcttagatgagtagattccccaccagcctgtcatacataagatattgataatacctgcaagaccgttgagaacgttccaccatccaccatataaccatacgccttcagatgataaccaccagcttgttcctgtctctgcaagtgcatgtgcacctctgattgcagattcgaaatcgctgcatactgcgatcaaaatgttgattgctacgatgacaaatgggaaagccttaaaccactgtgttttaccaataccccatttgtatttgagcatcataaaaccaatacatccagctgtagctgcatataacttcgcatagtggaaccagcttgtcatatgtacatatgtattgttattaagtgcccattcagctcccgctgctgctgaaacgtaaattgcaataaagtaaactgtcagaatgatcggaagaacaacgaaacataacattccgccggcttttgtacgtctggcaatttcatttgcaagtacgagacaggtaaaaactaaaatccagccaagaaactgccatgcagctccctcgccgtaaacctgaaacaacagtccatgatttaacatattgtttcctccctcataaaattattatttctggtcataccagtgattgttatgattttaacactttttttataaagtttcaacattatttacattttcatatactttttgacaaaattgtatattatttccaattgattatttccctttttttttgggatttctggagagactcttccaaaatgttttcaaggatattcttattttacctgattttgcatcaaaaaagatgttctgtggtacaaccagatccacgaacatctttttccttatactatccatatgtacaagcttatagatatcaatctctcaagggttatttttcatcctcgatcacaagttttcctgctgacacttccataaatacactctccggatctgcctttttcatcgcaagcagtaattcccacagattgtggatctgatttgccagcacaccggacgcctgaaccgcatacggcagcagcattggcagctggaacacacggattccaagcggtggaaggaagatcatgttggtcgtatgcaccttatctccggcagttttgatcatctcataggtgatcatcagaaaatcctgtcccttgtatttacagtaataagaaacataacattcatcgatcgtccaggatacaccgtcctccacttcgaccggtttctcagatacttcattattttctgttgtctgcacactgatgttccagtgaatttttccatccttcgtatcattgtacatctctgtcagcatatgactcaattcttctggtcttttcattgtttttctccttatgttgttctttttctatttctccaacgcatgttccccgatgcgcactgcatgcactacaaaacgttttcccgtggtagaacaggtcgacagtgtcataatatgatcgtctttcgtcacgttcactcctgtatcatcataggacttttgtttcatcttatcaataaatttttgaaaagtatcatccggcgcaaagccaaccgtgtaaacttcgtcggtttccggcacatcatagtaggcaaaaatctgataacggtacgcacactctgatgtatagatcgtaaaaaactgatgatctttataaaaatcctctgttttatattttttcaggctgccaaacatgcttaagtttttcatgttgtgcccatataggattgtatggtaatcctgaaaatccggtgtgttcatcccctccataaaaatacatccggcaatcgtctgatttccgtaaatatccgtgcgaagatacttctcatcatccccggaatataaaaccggataactgagctgctccagattatcaaaccgtatccagccgataatatccgcattgacctgctgaagttcttccagcttcacatccacatctgtataccaccacgaatcatccccctctgtctcctccgccacttccgtattctccgctttctctgaaatatagttttcctttaatgcctcataggtgtcgttggactgtttgtaattcaaaagatccggcaccagcataatgagtgctgccacgatcagcgctgcgccaagaagaaaaagaagaaccgttgaccggctgattttattttgtttcatgcccgtttctctcccactttactctgctgtgcacgcaaaaactgcctgcactgtttttgattgtaccacaaaatgagcagacctcatagtccctatgaaaatctgctcagatgttttaccttttatttagttgaaagaaacctgtgcaagtgcgtctgtgtaacttgcaaagccggctgcctgaactgcgcatgcagaaactttaatatcagtaaatgtggtatcctctgtcacattgtttccaaccgttacttcttcaaagatggttgaatgagcggatttggaaatcacatcttttttcgcatatactttgtagtcaatgttgtttaagttctgagcttttttatacgcatctgtcacatctatccagtcagaagcatatgtgatcgtaagatccggatttgcattcacgatttttgcaaatacccatgcatcctgtgaatcatctgccatgtgtacggtcggatctttatataccacttctcctgcaaccagatcctcgtacttattttcttttaccgtccactctccggtgccatcagcatccacatacagattgctgttttcatctcttgccactttggactcggataaaccgcctgtcagcggatcatcatcaaagtttacattgccgacggtaaaggtgttggtgacagttccggttgtgctcgtcaggtaagcgaatgtgctgcctgcgccaattgctccgatcaggctgattgctccaagcagtgtgactaattttgttttcttcataatttctgatctcctttttcatttcatgataatctatttattcttatgtactttccattctgcaacttgcgattcctgccctatcagaaaccgttttgttacgatactgttttatcactcaatggtcacacggcggtcatatatcagaaatttcagcaactgttcttcattccgtatttaaatttttcttcttatcctcctctaaaatatccgggatgaagtttaagaggatcagcacgatcaaaacaccgcacaccaccgcaataccaagcggtgtctttgcataaatggaaatatatccaagatacgggatatgaaatgcatacaccccgatgatctgctgccatgcaacaggagctgcatctgcaatattattagcgtctccctgcgtgacaacggtctgttcctccttatccaccgaaatgatcctgtgcgtcaccagcgttcccgccggaagctgataagtgacgactgctccttccctcgcctcactcgcggcaaaatttttatcatagacgatcgccccgaccgggatcccgggttccatgctgccgctcaggaccgcatactcatcatatccaagcattttcgggacaaacagaaagcctgcgatcacaagcagtccgagaaataccaccattgataatacactgcaaattttccttgtcattttcttttgcgcctttctgacttattttgttacttctgcaaaaaatcccttcaaaaccggaagttccacttgatctttggcctcataacttccggcaaacactgcctcctgataaaccgtgatatcaaaattttttgtcacatttccaatttttactgcatcaaataaattatccgtgttctgccccggtgcaaccggactgttgtagtaaaaccagccgtccgtgccctgataccagccgatcccgtcaccgtcaggatcatacagcgtactctcggtcgcaatgctgtccgctgccttgcctttctccgaaaaagcagttccgttccaggtaccgtttaacagcgtcacttctgtctgttccggtgagatcgtgatcctgacccggacaaatgcatctgaaattccggtgtttttcacgctcggattttttttcacggtgctgcctgctctgatcccgccctcaaactcttcctcgatctcagttgccacttttgccgcctgaaacgtattggtcaccgttcctgctgttgctgtgataattgcaaatgttgctgctgttccaataattccaaccatcagtgcaattgtgatcacaaatatttttttctttttccatatttctttcatacacactgcctccgattatttgcgcacatctgttgtggaatgattatcaacatctgtcgtcctggttgctttttcatggatcacaaattgatttttcacggcatctgtatccgtgagttttccatcgcttctggtcttattgtttttggctgtaacattcacacagtctgcctgcaaatgtaaatctgccgctgttgtgacaaagtcctctgcgtcaaagctgcaggtctcgtctctgctgcggataccaaccgcaaattgtgcgctgtttccggcaatctgtgatgcacagtttgtgtctgcggtaaactcttttaacgtaaagcccatcgtgtcaagttcttctactttatagattccctgcgcaagtccttccagtgtcgtctgtgctttcacattgaacattccggttgtcgtgttctgcttctctgcgcttttctctccaaatcttaacgtcttataataaacatcgcctgtcgtctgattggtgatcttaaatgtaaagatcggatcaccctcacacgctctgatatcttttttactgattttctttgtgatcgtaagcgttcccgttttcactttcacgtcatattttcctgcataggcttccccatccgcatgcgctgcctccacctgtgtctcatttttatagatcacaccgtttaacgtggagtttgcgttggaagcatctgtcgcttcctccaccggcagaaatgcttttgcgtaatacgtggtatcctgtttaggtctctcttttttcaggttttcctgcgtgatctcctcacggcagcctttgtccgtgtagaacgtcagatacacctgtgacattctggcgctgtccgcatctttcatgcgcactgccgcatcatctgcatagttttccagattttccccgagaaaaatcgtatctgctgtgtctgtgatctgatacgcaattctcacattcacggtcggctgcggcaattccagctgtgtgccgccaaagcttaaaaaggaatccggatttacatttgtagtcatattatttccacccagacaggattcttttgccacgatatggattgttttctgccagccggaggcgctgttttccttcggctttacttcctgatcaagccagctgaccgtcgttgtgccatcctcattgaccgttacctgtgcgccatccgctctcagacgttggatctcggcatctgtcagctcaaattccgcatcaataacgtccgtcacctgcactccggtcagggatcttgactgtgtgatcgtactctggatgttctgaaagattttgtttaactcctccgcagtatccgccgtaaatgcacagccggctgacgccactttctctcccagccatgtggcagtctcgttatttaaaccaagcccgactgtgatgaccgtacagcctgcctctttcagttttaccgctgatgcttctgtctccgttttgtcattgctgtccgaaggctctccgtcggagaacaggatcacatattttttgttgtcatcttctgccttctgcaattcgctgtatgcatgctccagtcctttctgtggagaggtaccgccgtccgcaaaaagcgcattgacggactttaacatctcatttttatttactttcgaaagaccgtggtttaatttgccctcggtactgctgttccacccattgccaatgccataaaaggtggcgattccgaccagactgtccggtgatgtatcggaaatacctgtcacaaatccgctggcggcgtcttttaacgcagaaatcttagacgtccatgctgccatcacatcactgtctgaaatgctctgataactgccgtccacatattttttccattgtccgtcgatatattttaccggatacttcgcatacacattaccagatacagccgccgttcccattccgacactcctatcatacgtccatggccaccagccactcttttcatatttattccagtaatatactttattgatatctaagttattcttcacactgctgaattttccgacatcctttaattgattttcaccggacaaaatttcattcatcgagccggacagatcaaataccatcatggcatccactgtctgtattttttcaactgtgctctgcgaggttgcaagtgaacttgcgtcaagatcgatctgatactctctgttctcccagtccgtcagtttcgctgtcttatgatattccacatccttctccgtaaaatcaaccggcttctccggtgggatatccggcacgtcatcgtccaccactttgatcacatccgcattcggaagcgtaaacttcatgttacagtttgcctttcctgcaccgcgctccatatataaaatggtcagatgatgttctttgtttttgtctgtcctgtcaatatagttccagagatcggccgtatctgtcagagcgtcatggataccgccaagatcaatgaccacctgtttcccatccagaatcacccagagatcatcatccccggtaaaagaatagttcagttccccgatataatctccaagtgtaaaagttacgtcatagcggattccaaaataaaaattattatttccaaatggcaggaaatccgcccccgcagttgctgccacgttgtcctctttgtctaaaacttctttcagttcgtaagtgtcaccactttgtgaaaattttaatctgtatccttctttcactgtcagaccttttgtctctgccgcagctgctccgtctttcggaaaaacgcccggttcattcacactgaaaagaacttctttgtaatcatcacttaacccggtaacgatccctgtttttttcgcattttctccagttcctccggtatacacgttgatatgctggtcgtctgtggttccgttttgacctgcttttttcgtgacggtgtcatattgattttcacttaaattctgggataccgttccgaccgtgaaacggttatctttttgctcagacggatagttggaatctgcattgatactcagatccgccctctgctgtccggctgtgtcataagggatcacctcgtagtcataaaacgatgcctcaccgatatagtccgtattttttgcctgataaaaaacttttacaacactgtcctcatggatctcaatgttttcaagttcactttgggaaaatgcttctccgtttacctgcacatgatccacatcccagtttaacgccttattgtagtcgctgatctttgctcccggtgccatcgtgcagacatcatcgctgtaaatttttgcactctgctcatcctgcgcctgatatttgctgttgtcataatgttcgatggtcacggtcacgttgttatctccatgattgacgatgacatattttgaaaaatgatccgtgccaaatgtcacctcgccgtcggcagaagtgttcgcattcatatccaacatctcattttttgtctcatcaaaatgatacacgctcgccgaatcgccctctttcacctgcgcaagcgataactgcacctgcacggttgccccgggctccacttcttttccatcttttacaaaggagatgtcatacgccacaacctcttctttttctttcgactcgccctccatcgctttatcgatggatgcttccatttctgctgtgacggctaccggtgccacgacaagctctgcgcctgccggaagatcggtctcattcgaaagtgtcacgaccacgcggactgcgtcattggaatagtcgaagacggtttttaattccggttgttctgtctcctctgtctcctctgttttctccgtctcctcgattgcttcagtcgcctcagtgctctctgtgtcatcggtcacttctgtgttctcgattgcttcggtgccttcgactgcttccgtgccttcgactgcttccgtgccttcgactgcttccgtgcctattgcattcccgatgttgttggtcactttcgtgctctcgctgttctctgtattcctgactttttctgtatttcctgttccgtctggatctgacatttttccttcctgcccggtactttcctgccctgcatttttcgtctcattcaacatctctgtggaaatttccgtaaaaacatccgtggtgtctacacttgtcgcattggtgacggtcacatcggatgtcagcaaagccaaacataacaggaatgctatcactttttttacactcgctgcaaatttcatagaatcctccttacttttgccctttgatctactgttttctcttccaaagatctcatccactgtatttgtttaaaatatgttccgctgttttcactttctctatatggatcttgattttcagattccggtaaactttatgatcctgataaaattttgaaataatccggtttgcggccagcattccaccctcataagtgcatgcagaaagcaaaatcacatactgcgaatcactgaactgtgccactgcatcccctggacggagcgattttttcaatgtctccgccagatgcggcatcgcattgcggatgcggaacagatctacatcactgactctgcttccggtatactcccccgcctttaaggtcagaagcagaatatattcattttcatcaaaacgcgctgtctttctcacctgaagcctgcaaatttcccgaaagaccggatacccgcacaaaaacgctcccgctggattctgttctgcaatatcctgatgtacctgtgcaattccctgcacatttccgcttttattctgtctcagtaatttgtcataaacgccctttaattttgacagttcacagattccgagctgctgctgcaacgtccggcatgcattctcgtacacttccagggcagaaccaattttattttttcctgccaaagccttgatcagataacaatataactcttcatcgagactttcctgctgaagtgcctgactgcaaagctgctccagattctcatattttttcgcgctgacataatattcgcacagataccggacgcagtttaaatacaaagagtgataataagtattcagcgtcatcacccagtgcatatctgcaacttttgtcatgaaatcaccctgatagagtgcaagcgccgcttttaatttccggattgcctccccctctgaaatagttttctgctttgcggattcaaacatttgttcgaactgttctgcatccaccgccacctcctgtctgggattccagcggtaggaaccatgatcggtcaggataaaatcctcatctccaaagtttttcttcagaaagactctcagacgatacatcagatttttcaatgcacctgccggatttcccgtttcttcctcctgccacagtgcatctgccatgtcataaaaagtcagtgtctgatttctgtgaataatcagataagccagcagatttatcattttgggagaccgtatctcttcctcattcacaatatgttcttcatccctgatctgaaattttcccagagtccgaatcgtcagcatgcagttctcctcctcttttccagctctgactgccagatttttcctgtaagtctaacatgcatgcattgccataaaagtcgaataccgtacctaaaaatcctgcttacttcgacctttttctatttttatatacaaggaaagcaatcagtcccgcaataaaaactgctgcaataccgccgatcaccggcacagccaccggtacagatgctgcatcgatctcctgtgctgcaaggtcggcatctttcccgtccacatcgccggaaacggtgctctcatcctctgctgtgtttgccaacggtgtctcgctctcttcgatgtcgacaactccatcgaccaacggagtctgctcctccggaatttcaacattgccattgtctacgttctggtctgcgttattcgcactattatctgccacgttatttgctgtattcgttgccgctgtatttgctgcattaccgccaccatttgcgcggttgtctgctgtatttgacgcattatttactacatttgcagtaacaccggacggctgggcagctccgggaacgatgaccgtctcctcgacctcacttacgactgtctctgtccgtgttgtgcccggaaccacgtttgtcactgtgctggtgattgtctccacagccccggtgtagcggtattcaaacgttgccgtgttctctttccctttttccagttttataattttactgctctctgtcggtgtataatccggaacagtcaccggaatgaccgtgattgtttcctctgcatttccataggtgatctgcggagccgctatctgttccttcgtctgactgtctatgaaactcaccgtataggaaaccggatcgatcagacgtttataatccaaaacatactctgtattccgctccaccacagttcccacaacgccgttaaaatctttcaacccatatgctgcctctttttcatagtgcaggcagttagaaaaccatgatgtcagccttgcatcactttcccagcccggcactgtaaaagcaagtgtatctccctttgcaacttttactttaatgtaattttttgtcacttccatcccttcggaaacagtaatcttatctatatcaaaacatgcaatatttcccgcacggaatgtcactgtatacattctttttcccaccgcttctttctcctccgaagctttcaccgttgtcattggaagcaccagtgccatgaagataaaaaccgtaagaaagcccgtaattattttttttacttttttcatgacttgcgctccacctttctttttttcactgctatactaacaatcactatacctgccaccagaactcctgcagatactgtcactgtcagagtatctcctgtcctgacaccgtttgccagtggaaccagctgttctgtaactgtctttgggatcactttctttacaatctttgtcaccacattgtcttctccgtgctccgtcacataatttgtgaccaccaccggctttctgtcgtctgcatagtacgcccggaattcaaattccatcgcaccggctgtgtgcgaataatcaattccatctgcgctgtccataccctctccatctaaggtcaatgtcacatagacatccgccgactcccccggatccagtgctgtcatataacgatactcattcaattccgtaatttctgctaaaccttcggcacttgccacattttccgcatatccaccggcatctgcatccagcaaagatatccttccggtatcattgccgatctccacctgaaactcatatgctccgccagacgcttttcctgcttcttccaaagcatccgttgtcttctgcgaaataaaaaaagatgccttatgactgttttgattctcaattttaatgacaacggtcctgctgtctccgggtgccatgccatcaaaagcaccggcaagctctgccttatcttttgtatacacaagctggttttcctctgtcagctgcacagtatgaatttccgccgcactgactaccgatgaagatccacaagtccaaataagcaacagaacggctgctatgttttttattttcatatgctccaatctccttcaaccgttatcttgtttctgaaacagacaaaatcgttccattttcatcaaactccgggaacacaccaagctctgctgcgatcgcatcttttgcgttattcgcctgaactgccgtaacttcgtattctaacgtatagactgcatctgcaaatccatttcccatagattccttaaaataaattccgtccataaagtttgttgtcgtctgttctggagccagcggctttgtgtagtacatcaccgtctgctcatcatcctcatacccgatgatccagtcctgattatgtacatagatatcatccgcctcccctgcactcacaagtccgccgctttttgtatcccatgcatgataaatgactacttttacatacacatcataaccatccgggatatcgttttgtactgccttcggcatgatgatcgtttcccccggcacgatcgtaaccggttctttttccccgccgtctgccagtgccacaggttgatccccgatcaccgtgactcccacactcttaatggaaatatttgccactgccttttcactttttgtattcagagctgcaagcgttccgccaaccatcgttgccaggatcaatactgcagcgattcccataagcatgtattttttcttcactctccatctcctccgctcatccattgaattttttataaatccttgtgttattataggtatccccggtcacacaatggtcacacgaatattttatgcagcagaccgcacgaaaaatgcactttgtttcttcaagtacgcaaaaatacctcccggcaggttcggggttgttacccgtatctgcccaggaggtatcctgtcatttcaaaaatattgatttttcttcacattttaagcaatcattttacatccactatctcacatagatattggaaagattgtctaaaatctctcctgcaacatccggtttattcatcgtgtaaatatgcacatgattgacaccgttggcgatcagatcaatgatctgctctgttgcatatgcaattcccgcctgacgcattgctgccgggttgtctccaaacctgtctacgatcgcaagaaatctcggtggaaccatattgccggacaaagatgtgatacgtttgatctggcttgcgttggtgacaggcataatgcctgctacaatcggaacatctattcctttttttaatgccttgtacataaaattgtataaaatgttattgtcaaaaaacatctgtgtggtgaggaactcgcatcctgcatccactttctctttcaaatggtcgagatcttcaaaaatcgttgctgcttccgggtgtccttccgggtagcatgcaccaccgatacagaaatcaccctgtgctttgatatctgcgatcagttcacttgcgtgcttgtactgatccggcagcggaaaatctgcatttgcaggaatatcgccacggagtgcaaggatattctcgatatttgctgcctttaactcctcaatgacagatgccaccttttctctggtggaagaggcacaggtcagatgtgccaacgccggaatgttattgttacgtacttcctctgctagctttaccgtataatcagatgttccacctgttgcgccgtaagtgacactcatatatgccggctttaatgccgccatatcttttacgatatttttataattttccagctgcgcaccctgttttggcggaaaaagctcgcaggaaatcgtcacttcatctttgtttaataattctgttaatctcatctttttgttcctcaatcttctttcttatatattaaaaacttctcagtttatccgttccatcatccaccgtattctcgatttttcgtatctctacaaaataggaatagttatcgtttacttttacttcgcagcggtcacctattttgtgtcccaacaatgcttttccgagcggcgattcgttactgatcagatttttcagggaattgccgcggatggttgtgacaattttataggtttcttcctcgtcatcatcctcaaaatagaccgtaacggtattgttcattccgacttcatcatccgcagaatccgtagaaataatctttgctgtcctgatcattttctccagataacggatacggctctcattctgatttttgtctttttttgctgcatggtattcaaaattttcactgaggtcgccatgtgcacgtgcctctttgactgcttccagcgcattttttctcacaaccagcttccgatactcaatctcttcttccattttttttatgtcctgttcggtcaactcgtcatacatgaatcccaacctccattttccatctctatcggtactgatcctgtaccattctcattatgatctgcagatctgtctcttataaaaacacctgttctaatgcgattttctccggcagacagcgttcgatcacactccctttccggcagacagacagccagacatcccgtttgacattccatgttttcagataatattctcccacctgttcttccatcgtggaaaaagaatccaaagacattgcgatccctgttccaaccgccttgatataggcttccttcctcgtccatattccggtaaaagcctcatctgtccaacatttttccagatattttctctcatcttctgcaaaaaaacgctgtgcgatcttctgttttccggtgcgcatcagctccacatccacacctatatcctctgtgccaaaagctgctgccacatacatgcccgaatggctgaggttaaacataagcggaagccgttctccctgccctgtcccaagatacggcttcccatttttaccataaacgaatcttacctgttgcaaagaccgtgtttgtccggtctgctccaactctgctgctgcaggtgatcccacaggtattgtctgcgtgtaaccatactgccgcagaccgtattccaataacagacctgccccaaaggcacgaagcctgtcatcttcatttttacattgttttattttctgttgtctggcgcagcacaaaaactcccacagctgtggttgatctgatctgtcacgtaaggcactgatatctgaataaaacacgcacagttgtttttgattatccactacttctgatgctcctgcagaacttctttttttcgccttgtggaatcccagacattctgcacacgtctggtcacgatctccggaataaacggttttacaatataatcgcttgcacctaattccatcgtcaatacctgttgttctgttgtatcatccgccgtgatgatcaccaccggaatatttaagatccttggatcattcttcctttcctgcataaacgtctgtccattcatgccaggcatcatcagatctaacaggatcatatccactttataattctgttcctctaaaatacgaagtgcctcttccccatctcctgcctgcaggatacggtaatctgtttcaaaaatactctccagcgatgcccggttaatctccatatcatccacgacaagcatggttttctcgtttacctcttcttccatcagtgcaagacggtactttgcaagttcattgtccatctcccgctggaccgtgatatcatcaatgcagccaaaaataatatggcgttcccctaccctgttaatatacttcaggcggagcttgatccagatttccctgccagactcgagaaaacgtttcacttcacattccgcagtactttgattctccacaacctgtgcaaaagtatccataaacctttctctgtcaacatgatcaatggatccctcaatctctttgtgcacacggtctgtgtcatgataaccaaacatgtcaaaataagcgtcatttacacgcaccacttcaatatttccgtcgctgtactcataaattgcggctgcctgcatcatgttggagaaaatcatttccatctgcatattcgctgtccagatggcattcgtatcgttggatgttcctcttgtctcatcatcttcaaagtatggctgttcatacaacagcttttcatattcttttaccggcattggtcttgcaaaataaaatccctgcacatattcgcatccgatgctgtgcagaaacgatacctgctctttgcgctcagcaccctcagctacgaccggcatgttcagccactttgccatgcggactaccgatgccagaatgttttcactcctgccatcatctccggaaccatccagaaacttcatatcaattttcaggacgtcaaccgcaatatcttttagtacattcagcgaggaataaccacttccaaaatcgtccatcaaaatagaaaaaccttttttctgaagctgttccatcatctctttgattgcttttgggtttcctgtatatgcactctctgtcagttctaactgcagccattccggtggaatattgtatttttctgtcagtccacagatcacatccacaatttttggattataaagacttacacgcgaaatattgacggaaaccggaaatatttttcttccctcatctctccatcccgcaagcagctggcatgtcttttcccagacatactgatccagcttcaggataaaaccgttccgctcaaataccgggataaattctcccggcgatatcatcctgccatctgctgtgatccatcgcaccaaaacctctgctcctgcaatggaatttcgctgaagttcatatttgggctgcaaatacagcacaaactcttcgttcttcagcgcattcttcatattgttgatgatgtgctgctccttgatgatctcctcgctcatctcttttgtgtaaaagaaatagttctggatataatttcccttacagtttttggatgcaagattggctttgtcatacatttcgttgatggaaagatcacggtttttcacaagatataccccgaagaaaggcgtgatatcaaaatccagaggatatttttccatctgattcgtgaatttcttcacaaagtctgtgatctctttctcattttcataagaaaagcataccgcaaaaatatctgcctcaattcttccataagtaatataacgatattctttttccacattctgcagataatctgccatatactttaataaatgatcaccctcatccattccaaaaaaggaattgatcagctggaatttttcaatatcgatcctgatgaacacaaaatcttccgtaccgaaaatattcagcatatttctcgtattataaaagaactttgatttgttcaaaatgccggtaagcacatcatactccgcacggtactttaattcatcatccactctcatctgactgcgctcgatcacattctttacacgaaaacgcacgatcatcggatcataaggtttccgcataaaatcccatgctccgtattccagacacttgcactcgatctcatcattgatgcctctcaacatcgcgatcacaggtatattctgatatcttacatctttgtgaaaaatttctaagagttccagtccgctcatgtccggcatgatcaggtcaagaatgatcacagttaccgcctgatacttctcctctaaaactgctaatgcattctgtccattttctgcttcaagcacgatataattgtcatttaaaatttcccgcaatgcagtcctgttatgtcttgcatcatccacaattaatattgtatgtttccttgtcataagcccttgtgccagtccttctccatttgttagtggtttcagccaccagtcaaaatcttttttcttccgtacataccatatacttatatgataacagacttaatttttcttttcaatacaagaatttttatctgtcattcacttaaaaatccatgtaagagagatacagctcctcaaaatcattttcttctgccagattgatgacgtctgccatggtctggattttttcaagttcttcttttgaaattctgctaagtaaaacctcttttgtccctgcaagaactgtatttccggccggaatcgttttcatctccagttctttcgggatcaggccaatccctgccgcctttttgatatctatctttgttccaaatccacctgcaagataacagttgtccacttcgtcaaacgcaatacccgccttttttactaaaatatccactcctgcgcggatcgccgcttttgccatctgaagttcccggatgtcattctgtgtgaattttactttttctgccagttcatatccggtgtcaaaataaagatccgaatatgttccatgttcatcgatcatctgatgctcccggagttcatacaccagatcgatcatacctgttccgcagattccgatcgcctgctgtttcttattttctccatctgtttcaccgatcacctgaaatccggctttccctgtctcttccatgaaaacatgtgagatcactcccggaatgctcgccatgccacaggaaatatttccaccttcaaacgccggtcctgcagacgtggacgtcacatacatatgacggcaatttccaagcaccatctccccattcgttcctatatccagcagcaaatgatatccttcggatctgtgcatattcatttttgcaatgccagccatgatatcagcccctacaaacgctgagatcccaggcaaaatcacaacttttgtatccaattctttcattccaagaaaatccgcagcactgccttccatccatgaaaggtcaactggcagaaaaggcgccacacccagcgtctcacatgaaaatccgcgaagcagatgacacatcgttgtgtttcctgcgatcacgatcctttgtatctgtgccacatggattccctctttttctgcaagttcaccgaccagcttctgtaaatcctgccggatgcagcgctgcatctcccattttttcccattgttagaggcatctatccttgaaatcacatctgcaccgtaggttctctgatgattgaccgatactgcggtctgacagtccgcttcggttttcaggttcactaacaaggctgccaaagtcgtggtgccgatgtcgatacagattccataaattgcattttctgttttctctgccgttccttctgctgtatttttcagaatttcttctgttctctgattctcccactgcgaaaggacttctatcgtttcttccagttccggaatttcaactttgtattcttccgttggatatgactggcatgccagacgatagccttgctccaactgcttttccgataaaaactctctatcctgcttcgtcggttctgttgctccgcttttgtaccgcacaatacattttccgcagattccattgccattgcatggagcactgatgtattcatttttttcctgtaacatttccagaagatttttctgttgttttgatctgtctataatcattttttcctttaccctgaaaaatcaacaaatcagcacagcttcctcgatggaaacagtgctgatttttgtattttatagtttttcaactacgactttgcaacgttttttacagaatgcaattccgtatgcaagaagatcgtttcgtccatcctcacggagttctgcgtcatatctgtgattcttaatctgctccatagctcgttcacacgccttgtcaagttcattcatggaatgtgcgtatttcagttctatcacgattccaacatctggattcttaggcttaagcaaaatatctgcatatccatcaccagattctctattcgatttaaccgcccagcccgaataattttttaaaataccgatcagaataccatgataaaaaatctctttttcttcgtttcttgctttcgtatctaaaacgctgattgtttcgccaagaaacattgtaagttcccgctggatgtcatctgtctttccttcaagaaaacccctgttgattttttccgtagatgcgtggtcattcgcaactacctggtcaaaccagtcacggatttgtaaaagaaagacttccctgacttccttgtttggaatgatcaatctatacatcccattttctacatcaccattttttgtgagatatccggttgtaaaaagaacactccacaaattatcaatgctgttatcaatctcgtcgtaggtcagatccaaacggattctcttttcgactgcctctcccacaatcaattgttcgatttcatcctttgtagttttatctgccatgtcgataaatcgttttacaagatcatttccactactgttaatccaatatgcctttggctgcgatttagcctcacttaccaaatcgtcaacataattgattacatcccatgggcaataaatatctgcattaccaaaacgatagccatcataccattccttcacttctgtgaaatgcttctgcagattgtaatcttccagcagtttttttacttcttcattcgtaaagccgaattcttcatcatatcgaacatcgtctgccgaataaaccttaaaattattcaagccagtaaagatgctctctttggaaacccgaaggcatcctgttaatacagcaaactgtagaaaatcatttgttttaagtgcttcaccgaacaatccacgaataagtgccaccatttctctataatagccatgctgaaaggccttatcaagtggaacatcatactcgtcgatcaaaacaatcgttttctgaccatagtgttgatataaaagttctgaaattttcttaagtgagaatttcagcttcgttgcaagagtagtttcctgttccccttgaagtgaaatcaaatcacgatatatattcttttcgtcattgtccagtctgctactgttcagcaagaacttaaatcgtctcacctcgccagcaatcaactcacacagggcagaccgtgcttcttcaaatgttagtccatctacacctttgagagacagaaatataacaggatactttcccatatattccttacaaagttcttcattctgcgaaatataaaggccatcaaataatgctgtgtctgttccaatctcgaaaaagctcttaagcatactcatatttaaggtttttccaaatcggcgtggtctggtaaataaattcactttactccaattttcaagaagctgctctaccaattttgttttatccacataataaaagtctaacttccgaatttcctgaaagttctcaaaaccgactggaagcttttttaattcctgcatattttacacgctcctccgaagctttagtcttaggattgggttacatacagcaaggtagacctgtcctagtgtggtttaattttaccatttagtttgacaagtatcaagccgataagtcgttgctaaacaaaaataacaccgattttcatatgttagtttctttatgaacaaaagcaaacggggcatttaaatgaatattcaaagaatccgagatttgagagaagattccgattatacacaggaatatattgcaaagctgctgaatgtaaaccagcgcacttattccagatatgaaaatagagaacatgcaattccacttacaatactttcttttctgcagacacacaaaaaaccttctccaaagaatgcgtactcttatttattgctgatagctgcctgagcagagtacacattacatggtgttaccttaaccattatttgtagtgcacagctgtattgcaggtgccatagttgaagggggtaatgctgagatttaaactctcttctaaactggaatttctatttgtgttgccatgtcattacataatctttttctccggtagcctcatctaagccactatgctgaatctcaaatccttctctcttataaaaagatattgcccgtgcgttcttttggtatacgttcaagtacaacttattccttttatcctttgcataattcagcagaattttacctataccctgcgattgcatttcaccagaaacaaaaatgccctcaacatattcatcatttaaccctagggttaaacttaactactattttttctttgcgatataaaatacataactgtaataatctactactaatctaaaataaagcgattataaagcatcattatccttttctgaacataattccttataagtctctatagataataatggaaccctaataataaacgtctttcctacttcatatggcatcatatcaattcctcctaattttcttttactttatttcgtaactcttttattactccgacacttgaatcaaatacttaaaagttctattaccaaaacataataatctttttcacataacgttatatatttattattttttgtattatatactttacattttgtttgatatatcatataatgcatatagaaaggaggttatataaatgaaaaatatgcgtcttaaattagcgcgcgttgagatgaatctttctcaagaagaactggctgccaaagttaatgttacacgccctactatcaacttactagaaggcggaaagtttaatcccagtcttcagctttgtattcggatatgtaaagtacttaacaaaacattaaacgatttattttgggaggaggacaacttatgaaaaccaccattcactgtgatgaaaggatcacaaatattcggaacacaatttatgttaaacttttttggggtataattatattagataatcttactaatctactagattatttttttcaaacaagcttaaacggttgggttatttcattagcgccttgtgcgttaatcatttggatgtcaataaaaggagttctttttaatggaacccaacattttccacactggtgttggctatttgcactatgctattccagtttaaatagtattaccatttttgttatgagttccaaaattgatacttttttctatcttgaactaattaatcaaagaattatagtctccttaatatttctaactgtttatttccttgtaacattgttatttttttacatttcttatcgtattgctctaagaaaaattaataaactttctactgacatctaattatgtaaaattaaatgattatcaatcccacattcttcttttaataaagcgataaggtttccccttatcgctttacattgaaattaataataagagtgctgcttaatgcttattttctataacacagttttaaactttttaattatccaattctacgacatgcagctccacaatatgaatgacatgcagaacaagctatcctttttcctgtgtttgttttaaagttttcatctatacacttttttatcttttcctgttctttttctttatccataaccgttaaattttcaagcaaatcagcttcccattgtatttgaaaatcaagtccatcaattttagatggagtatgatggttgcctattataaagcatattctatcaatatttttgttatagcctaccttttttaatatttctttcgctacttctggtccttccttttcttgatagacaccatcaatagaaccgtattttttttgtgcttcaaccgcaccaatatcatgtagtatagcaataatactgatgaattctttttcttcctctccgatattttctcctttcattatatcttctgcatttttcaaaactttgagagtatgctctatgccaaaaggaatttctttgaatacttctttcatctctataataattttttctttaaaacataaattacctccatttataccttataggtgttttagttctatctatccacttttttgttcgccgatacaatcagcatcatgggacggcgcatttcatcctgcatcccaggaatatccatcatgtattccggcggctgcggctccacaatatgatttattataaaaccatttgaaagcagtgtatttagatatgtggtcagtgttctatgaaattttgtaaccttttctcccaaaaacacagctgttcgtttgccctcataataataattatccaccggaaaatgcagtatttctcctttttcgttataataccagtcttgtgttccataggcagtaaaaacaggatgttcaaccgtaaaaactagcttaccaccagacttcagtattctatatatctttttactaaaatctcataatctgctacatagcgaaacgcaagtgaacttaatattacatcaaaactctcctctgggaattccacatcttctatagcacagcatttatattcaacctgtggaaaatgtgttttttctttggctacctcgagcattttatgagaaatatcaacacctacaacagaagacgctccgtgttccatcgcataaatacagtgccatccatagccgcatcctaaatcaagcacacgcttatcttttaaatccggcagcagctttctcaatgtttcccattctcctgcaccggctagtccctgctgtgagcgactcatttgactgtatttttgaaaaaatatatcatcatcatatttgttttcttttccatattctacataattcaacatctttcacctcgctgtaaacttccgattcgtctctccgttaaacacaccggcttattgggatttatcagttaataagtttactcgccagtttgtatacttgatttatttctttgctttctaacttccagttattgagttcatctttaatcagctccggaaattttttactaatatctcttaaagcattacctactgatttcctaacatattcactcggatcttcttttaaggctacaatccgcctaattgcttcattcggattatctttgaaatatggtctacttgtccatattcttaatccttccgtaactgctctcctcgtatttggattatcattttctaaccagtcatcaatgatcagaagtgctttttcatatcctgtatttttgcaaaattcatcaaatgcctttgctaatacttcctgaactctccaattatcatctttagaaacttcatctctcataaatgtcaaaatatcattttgttctgataagtatccaaaaagaaatacaccgtacattcttacttgataggtatttgagttataagctaaaaacgccaacttcttgacaaattctttatcattagatctataatcggataaggctcttttttcttcctctttaaaaccattttctatcaaagaaaattctttttctaaactcgcaatataattttccaaacaaaatcaccttgctttcaaattcaaattcaaattcatgcgcgctttcaatctcaccggaagactgaaattttaaagtgtgcgtgtttacaataacaatctttctgcttcacatatattttcgacagttaaaccaatacttgcatctgtaagtatttgatgttttctaatttcttcattatgcaaatcaaggtcatcaatcactatccacttttcaatattgtcgtgctgtgatacccatgcaagtatttcactcgctttaacaagactaaattttttgctttttcttatctcctccgttgtatggtctggagttacaccattgacttttataccttccttttcaagcatacttatcaagcgttctgcttctctacgcaatggctttacttcactatcaaaccaaaacttccaaccggaatgtaatataacctttgcacttgtgtttcttataagttgccccaataacattactttttcttcatcaataagtgttccatcacttatttctctttgatgtgtatcattccagaaattagagttaagaacaccatcaatatctaaaaatattactttcataatatataattcctcgctaaattcacagtttttatcttgtagtaatcatattacatcttccccaagattcatccttaaaactaaacgcattctctgttaacgttctttccttaaatcccgctttttcataacatttcttcgcaccaggattttcctgaaaaacattcaaatgtactgcatctgctttcgctatttcaaatgcatatttaataaaaagattactagaattaaaagagaatttaccactaagaaaaaaaacctcgctactgatagaaataccggtagtgaggttctttttattatattcattcctgccattgaattaagttattaattctcacagaaatatatccatattcagcaataccttctcaaagttttgcttcttaatttagtgataaatcactcgcctacttctgagagatagctgcctgagctgctgctaaacgagcgattggtacacggaatggtgagcaggaaacatagtctaaaccaatcttgtggcagaattctacggaagaaggatctccaccgtgctctccacagataccaacatgaagttttggatttactggtttaccaagtttgattgccatatccattaacttaccaacaccgttctggtcaagttttgcaaatggatcgttctcgaagatctttgtatcatagtaagcatttaagaacttaccagcatcgtcacgggagaatccaaatgtcatctgggttaaatcgttagtaccgaagcagaagaaatcagcttctgtagcgatctcatcagcagtaagagctgctcttgggatctcgatcatagtaccaacttcgtactctaatttaacgcctgctgctgcgatttcagcatctgctgtctcaacaacaactttcttaacatattttaactcttttacttcacatacaagtggaatcatgatttctggttttactgtccagtctgaatgtttcttctgtacgttgatagctgcacggataacagcttttgtctgcatcttagcaatttctggataagtaactgcaagacggcatcctctgtgtcccatcattgggttgaactcatgtaaagaagcgatgatgttcttgattgtctcaacggatttaccctgagcttttgcaagtttctcgatatctgcttcttcagttggaacgaactcatgaagaggtggatcaaggaaacgaattgtaactgggttaccttccaatgcttcgtaaagtgcttcgaagtctccctgctgatatggaagaatcttctcaagagcagcttctctttcttctactgtatcagagcagatcatctcacggaatgcagcaattctgtcttcctcaaagaacatatgctctgtacggcaaagtccgataccttctgcaccaagctcacgagctttcttagcatctgctggagtatctgcatttgtacgaacttttaatgttctgtatttgtcagcccatgccataacacgaccgaactcaccagcgattgtagcatcaactgtcttgatagctccatcgtagatgttacctgttgtaccatcgatagagatgtaatctccttcatggaactcttttccagctaatgtgaatttcttattttcttcgtccatagcgatatcgccacatccggatacacagcatgtacccataccacgtgcaactacggctgcgtgggatgtcataccaccacgtactgttaagataccctgggaagccttcataccagtgatatcttctggagaagtctcaagacgtactaatacgactttctctcctcttgcattccaagtctcagcatcttctgctgtaaatacaactttaccacaagcagctcctggagatgctccaagaccttttccaagtggagttgcagcttttaatgcagcagcatcaaactgtggatgtaataatgtatctaagttacgaggatcgatcattaatactgcttcttcctctgtcttatgtccttcatcaacaaggtcgcaagcgatctttaatgcagctggagctgttctcttaccgttacggcactgtaacatgtaaagtttcttgttctctacagtgaactccatatcctgcatatcatggtagtgattctcaagagtctcacatacttttaagaattcagcgtaagcttctggaaattcctgctccatctgtgcgattggcattggagtacgaacaccggcaactacgtcttcaccctgtgcattgattaagaactcacccataagtttgttctcacctgtagctggatcacgtgtaaatgcaacgcctgtaccggactcgttatttaagttaccgaataccattggcattacgttaacagcagttccccaggaatatgggatatcgttgtcacgacggtaaacgtttgcacgtgggttgtcccaagaacggaatacagcttcaatagcaagttttaactgctctacaggatctgaagggaagtctgttcctaactggttcttgtactcagctttgaactgctctgctaattcttttaagtctgctgctgtgaggtcgatatcgaatttaacgcctctttcttctttcatcttgtcgataagctgttcgaaatatttcttaccaacttccataactacgtcagagaacatctgaatgaaacgtctataggaatcgtaaacgaaacgctcgaatgctggatctgggttaccagcgatcatagctgctactacttcgtcatttaaaccaaggtttaagatagtatccatcatacctggcatagaagctcttgcacctgaacgaacagatactaataatggattcttaagatcgccgaatttctttccgttgatctcttccattttcttaacgccttccatagcctgagccatgatctcgtcgttgatcttacgtccatcttcataatactgtgtacaagcctctgttgtgattgtgaatccctgtggtacaggaagtccgatgcttgtcatctctgcaaggttggcacctttaccaccaagcaggttacgcatggtcatgtcgccttcgctaaacatataaacccatttgtttgccattttataattcctcctaatataaaatactgtaacttttattcaaacagagagcattaacccctgttcttgtcacaagtatgcacgtttttccaaaacgcacatacttataataccacacattaaccaaaaggcaacaacttttttgcttcttttcgcctattttttatgcacatttcacaatttgaaattctattccatattatggaactcttaccattcaaatttctttgcaaaatatgcatccagatcttcgatcttgatacgctcctgctccatcgtatcacggtcacggacagtcactgctccgtctgtctcagactcgaaatcgtaagtaacacagaatggggttccgatctcatcctgtcttctgtaacgttttccgatatttcctctgtcgtcaaactcacagttatatttctttgcaagctgtgcatatactttctcagcgccctcatttaacttcttggataatggaagtacaccgatcttaacaggcgcaagtgccggatggaaatgaagcacggttctcatgtccggtttttcctctgtaccaatgttctcctcatcataagcagcacataagaatgcaagtaccacacggtcagctccaagagatggctcgatcgcatatgggatatatctctcacctttttcatcatcaaagtaagtgagatcctgtcctgatacgttctgatgccgtgtgaggtcatagtctgttctgtcagcgataccccataactcgccccatccaaatgggaataagaactcaatatcggttgttcccttgctgtagaagctaagttcttccggtgaatggtcacgaagacgcatctcatcctctttgataccaagtgtctgtaaccagtcacggcagaatcctctccaatactggaaccactcaagatcagtacccggctcacagaagaactctaattccatctgttcgaactcacgggtacggaatgtaaagttacccggtgtgatctcgttacggaaagatttaccgatctgaccgattccaaatgggattttctttctggaagttctctgtacatttttaaagtttacgaaaattccctgtgctgtttcaggtcttaaataaactgtgttctttgcatcttcagtaacaccctggaatgttttaaacattaagttaaactgacggatgtctgtgaagttatgtttgccacatgtaggacatgggatctgatgttcctcgatgaaatctctcatttcttcctgtgtccatccatccacagagccctttaattcaatgttcttctcagcagcaaaatcctcaatgatcttatctgcacggaaacgctcatggcactctttgcaatccattaacggatcagagaatcctccgagatgtccggatgcaacccatgtctgtggattcataaggatggcacagtcaacacctacgttgtaagggttttcctgaatgaatttctgccaccatgctctttttacgttgttcttcaactctacaccaagatttccgtaatcccatgtatttgcaagacctccgtaaatctcagaacccggatatacaaatcctcttgattttgcaagtgctacgattttgtccatcgtcttttccataataaattcctcacattctattatattattgctgtattatgcaattatttataactcgtacttatgatttattgtatcatcgcgagcctatttgtaaatgatataagtatagacatctgtaccggatgaaccgccggaaagatttgtgactacatcattgccggaagcttcctctgttcctatgatcacttctccctcaatgacatcccctgcgtcttccgtactttctgtctccaagacggcctctgtggatggtacttcttctgcttccgtgatccaggttttctcgattccggttccctctttaatggaaacagaatcttttcctgtcaccgtcacgttatcgcaggaaacatataaaattttgccgtcaatcttcacatcggtatttgccttaataatgacaactttcagatcttcctgtgcgagaatatcccctctcgtcactcccgtgacactgccgtctttatccacgcccgcaaaatctgtgtcaaaatcatacccggcagccaatgcctgcacgattttaccctcatacaattccacaccattaaacgctgtataatcatccaccgtttcatagtccatccggagttttgctgtgccatcttccacggtcagatcatccacttttacagaattttttccattctctgtattgtactcatccactgcggaatccacaaactctttcagctccgtctcatcataataagactggtcaagctgttccacatccattgaaactactttgccatgttttgaaacataaacggtatttgtgtctgcctccagactggaaccacacccggcgagcatacctgcgcagatcatgattgtcagtccaatacaccctaatctcttcatgttacagactccatcctctttctatttcattcaatgttaatcttggatattatacaatttttatatcatgttttcaacctcttccaaaatttttaatgatttaaaagaatggttgatataatatttcatgtattccctgatacactgctgtaattcccacaatacctgatcggatacagaaaacgtgtaaagttttgcaagctttgctgtcataatatactgcatggtatagactgtggattcctgcactttctgataggtcggcaacgccgccatattttcaggtttccgccttaactcattcacgcagtgatcgcaaagcatgcgcgccgtctttcccgaaaaccagtgcagtgcctctttttttccgcattttgtgcacccgaacacattcggtgcttccccgttgattgtgagtgtccggagttcatagatacatctcacaagccggttggaaaaagcagggctttcgagcgcccggagtgtctggtaaagcagttttaacatttctgtctcatcgttattttcctgacaataataatctgcaaattccagaaaataaaatccataataggcagcgttgaaatctgctgcaagctcccggaaataattctggatggacactttggcaactgtatatgtagaacgtccctcgaaaagttcaaattccccgaaggagaaaggatttgtcgcagctaaaaactgactgtttggttttcttgcccctctggcaaatgctgtgatttttcctctctccctcgtgagcagtgttattcttttgtcataatcgccaatcggcatcgcatttaaaaccattccggtcattacaaggttctgccccattctgccttacttcctgctctctgtcactctctttttctctgcatatctccagataatcgtcaatccgtcctgtttcccaaaaagtgttccaggttttctccatcgtttttccctcctgccatctgtatacagataggatttgcgttgtgaaaaaccttatacacgttaaatattggcaacggtttaaatttcgtccttattgtatccaaaatttttgatcagaaaatcgctgtcacgccagtctttcttcactttcacccaaagtttcagatttacttttgtatccaataaccgctcgatctcgtaacgcgcattgcttccgatttttttgagcattgcaccgccttttccgatgataattcccttgtgggaatcacgctcgcagacgatcgttgcgtcaatgtcaatgatattctgtccctttctgcccttcatccggtcgatataaacggcaattccatgcggaatctcatcatcgagcgcatgcagtgccttctcacggatgatttctgcaacaatagcgcgctccggctggtcggtgatcgtatcctcatcatagaactgcggtccatacggcagatatttgaaaatcatgtcaatgaccgtgtccagattctttgcacgcagtgcagacgccggaataatctccgcaaaatcgtacactttgcggtatgtgtcaatatattccacgattttttcacggtctacggtatccactttattgatgatcagaatgaccggtgtttttacttttttcaactgctcgataatgtgctgctcgccggctccgataaaattagacggttccacaagccataagatcacatccacctcatttaaggtatgctctgccacatttaccatgtactccccaagtttattttttgccctgtggatccccggtgtatccagaaatacgatctgcccacgttccatatccgtatagaccgtctggatgcggtttctggtcgtctgcggtttgttcgatgtgattgcgatcttctgtccgatcagatggttcattaatgtggattttcccacgtttggtcttccgatgatcgtcacaaatccggatttaaatttttcgttcataaacttcctctctttgtatttatttactcagataattgtaaatttcacaatcatcgttctgattcattcaagtgttttacttccccaaacattccttcacttgcctgcaaggtttcctcatttccgactacacagagattattctctgcgagaacagatgcgatcatatcccggagtccccggatatcctcctgcgtcgcaccgatcacctgatcacgctctttctggatctcttcgtacgaaatattctgtaaataagctgccatggaccgatcgcccttcgtgcttggattcattggcacatccatatcactgatcgtcccgatgatatattttgtcatgtcacgttcatccgcagtaaactgctcaatatatgcagggattccgtcataaatctcatttgttttttccagatttggatcacggtaagagacaaaataagtgtctccattcttcatataaccgttcatgcagccgtatgctccgcctttcacacggatattgatccagaggtaatcatactccatgatcacttttaaaatgcgcagtgcaccgtgatagtcaaagccatgtgcacggaaatttccggctctcgccacatacagcacctgggaggcatccataaatccctcattcttccggaccgggacgatctctgcctgtttttcctccccggaagtttcatataacattggaataaatttttccagctctgtttctacgatagaaagcccgtctttttcgcaggtgacgctgaccagaagatgttcttttgtaaaaattgaggaaaccatctcttttagttttgcggtcagtgcttcttttctctcatcaaaatgtgcttccagatcacacagcgtctcatagaatgtgatcgtatctttgtaagcagccgccttggaaaaataagtcatggctcttgtcgaagccacggaatgtccggcggaactgatgcttacctgaagtcttgatttcaactcggcaataatctcatacagacgcttttcatcatcaatgtttgaggtgaaaagcatttctttcatcaatgtagctgcttccggcaatttgtcatataatgccttggtgcgcacctcaaatttcacctgataatcatctttatccttcacgctcggatacacaccgatcgtactgctgattcctccagtatggatgttcacctcatttgcaaaatccgcataggaataattttttgtatccacatagccaagtaccgccttcaatacgccaagatacggaatgtcctctgccggaatgtgcgcaatatcgaacaacatggtcagatagatgatcccattcgaataaatatcatggtgtaccaccgggatacctttcactgaaagttctgtattataaaaaggtgctgcctcttttttcatatcagagcgcgcaagcatcggaattttttccagatcttcttttggagaaggtgtctcctgatattccttcaggtgttttgtatctgcgatcagctttcggatctcatcttctgataaccccgctttatattccgcaagttttttctctaaggcagcctcattttttgcatttaagcctttctcaggttcaatgatcacaacagatgcatgcctgttatttaataaatacttctggatcagctgctcaaaataatctgtctccacctgctcttttaagaaacggtaagtatctaatgcctccagatgaaggaatggacgcatatcatcataaagccagctgtccagacactggatcccatataaaagtccttttgggaaatgtccgaaatcagcctcacggtaacggaattcagaactattgatccctgccagcagcgattttttatttaatccattttttacaagcccttctaatgtctcacggatgacagccagaaaatgctctttttcctgcggattggtattttttgcgatcacagaaaatgtcggctgcagcgttccactgtcatatccgcctgtgatctctgaaccgatcccggcatcgatcaatgcctgttttaacggtgctcccggcgcactgaccagcgcataatccaaaatatcaaatgcgagatacaatttctcgtccagtgctgtttctatcaccgtgttataagaaagataggtattgttttcttcggattccgtggaagaaatggaatacttatgtgtcacttcgattggtttttcaaatggtttctgaagctttatctctgaatcaagcccgattgcctcatatttccccagatatgcttcatccatccacgcaagcttctctgccacatccatatctccatagagataaatgtaggaattgcatggatgataatatctgcggtggaaatcgagatattcctcgtaagtcagttccggaatatgcagaggatcaccgccggaaacgtttgcataagtcgtgtccgggaaaagagatgtcatgatctgacggctcaagacatcatccggtgaggaaaaagcacctttcatctcattgtatacaacaccgttgatggtcaccggagcatcctcgctctctaattcatagtgccatccctcctgcttgaagatctcctgatatttataaatattcggatgaaaaaccgcgtccatgtagacactcatcagattctggaaatccttgtcattgcagcttgcgactgggtagattgtcttttccgggtaagtcatcgcgtttaaaaaggtattcaaagatccctttaccagttccacaaaaggatctttgaccggatatttgtcagaaccacacaaaacagtgtgctcaatgatatgtgccaccccggtggaatcctccggcggtgtgcggaaaccgatataaaagaccttattgtcatcatcgttggaaatcactgcgatccgcgctccactttttttgtggcggagaataatcccctcggaattgagatctttgatcgggcgtttttctaaaatttcatatgcctgtaaatcttttaactgcatctgtctgtcctctctctaatacatactgttctatagtataccacacttcgcggcattatcctatttttatcttcgaaaatttctgaaacaaaaaaagactgtaacaaccattccctattcttaaggaataccgtgttacagtcccccgcttttcagattctcatctatgaattagccgatgcgtcttacatttgctgcctgaggtccttttgctccctctgtcacttcaaattcaactttttcaccgtcttttaactctttgaatccatccatgtctaatgcagaaaaatgaacaaatacatcgttaccatctgcgtcggaaataaatccgtagcctttttttgcattaaaccattttacagttccctgctgcataacaaaatcctcctaatacctctaaaacctttttgtaaatttgacatgtttttgtgcatgtcacacaaattgaagttagcatacatcggattttttgtcaacaactattaataaattttactgcttgatctgcacatcaatctgctgatacggaatcgaaatatgattttcatccagtgcatatttgatattttccatcaaccgccacttcgtatcccagtaatctgctgttttgacccagatccggataccaaggtccaccgaagatgcaccaagattatctacgaacaccacaacgtcctcttccggcagtcttgccggatcatttctgccgatctcatatacaatattttttgcagtacggatatctgcttcataaccaatacctaccacaatgtccacccgccgtttatccatatgcgatacattgaccaggctgctgttggacagattaccgtttggaatcacgatcattttattgtctacggtctttaacttggtatagaaaacagaaatctcgtataccgttccttcatttgagccctcaatgatataatctcctaccacaaaaggtttcagcaaaaggatcagcactccgcctgcaaagttggagagacttccctgcagtgcaagaccaaccgccacaccacaggaaccgagcactgccaccgctgaggtagttgctatcccaaacaggcttaagattgtcaggatcaggataaaatacagtgcatatttcacgactgcagacaggaactgtatcactccgacatctgcatttctgcgctccatcgtttttcttacgatctttacgatcagaccgatcagtttcgctcccaccgcatatacgatgaccgcaatgactacctgcagtgcaaaattcaaaagatccggaacaaggttttgaaaataagtgcggagaatcccgggattttttgcaacctcctgaagattttcctgcgcttcggcaatggcttccactgcctctgttgtatcaactgtcagcaacatttttctgccctcattttttattttactttacgtacttttaagacgccctcaatgttctctaacttctgaatgacatcctccgtcacaggggaatccacatcgatcaatacatatgcataatcacctttggatttgtttgtcattcctgcaatgttcattccggcatctcccaatgttgtggagtactggctgatcataccacttacattccgatgcaggataccaattcttcctgcggtagtacatgcgcccatagaacaatccgggaagttcacggaatggacaatgttaccattctccatataatcacggatctctctgactgccatgatcgcacagttatcctctgactctgcggtagatgctccaagatgtggtgtaacgatacatccctttgccccgactgtggttggattcgggaaatcagatacatattttttgatttttccggcagctaaagcttccaccatagcttcttcatctacaagaaggtctctggcaaaatttaaaacgatcgcatttggtttcatcatggcaatcgcttctgcattgaccatcttccttgtagaatccaaaagcggaacatgaatcgtaatataatcacactcacggtaaatatcttccacattgctgatatgtttgacacttctggaaagattccatgctgcactgacggaaatgtatggatcatatccatatacatccatacccatatggatggctgcattggcaactaacacgccgatagcgcccagtccgatgacaccgagtttcttgcctgaaatctcagttcctgcaaagttctttttctgtttttctgctgtttttgcaatgttctcatcattctgatttgcaagacaccagtcgataccgcctacgatatcacgggatgcataaagcattcctgcaaaaacaagttcttttacaccgtttgcatttgctcccggcgtattgaatacaacgattcctttttctgcacatttgtcaagaggaatgttgttgacaccagctcctgcccttgctactgcaagcaggcgatccggaagttcaagatcatgcatggcagcacttctcacaagtgctgcgtctgcctgacctaagtcctctactttttcatagtcgtttgagaaaagatctaatcctacggatgcaattggatttaagcaattatatttgaacattacgcattttcctcctcaaacttcttcatgaattctactaatttttcaacgccctctttcggcattgcattgtaaatggatgctctcataccacctacggtacgatgtccttttaagtttacgaatccggctgcggcagcctcttttacaaacttggcatctaattcttcattgccggtcacaaacggaacattcataagagaacggtcttcttttcttacagttcccttgaacagtctactctggtctaagaaatcatataagatttttgctttctcttcattgcgctctttcatcacagagagtccgcccatcttctttaaccatttgaacactttgccacagatatagatattatagcaaggtggtgtattgtaaagagaatcattgtccgcctgagttttccattttaacatggttggggttcccggaaggacatcatcggtgatcagatcctcacggatgattgcgatcacaactccggcaggaccgatattcttctgaacgccgccatatacaactccgtaatttgtgacatccatcggttcagacaaaaagcaggaggatacatcggatactaaaatcctgccttttgtgtctggaagttttttgtattttgttccgtaaattgtgttgttttcgcagatgtatacataatccatatcatctgtgatcggaagatccgaacaatccgggatataagagaatgtctcatctgcagaagaagcaagttcaactgcctctccgtagatttttgcttcctggaatgctttctttgcccactgaccagttaagatatatccggccttgcggtttttcatcaggttcataggaacctctgcaaagaactgtgaagctccgccctgtaaaaacagtaccttgtaattgtccgggatatttaacagatctcttaaatcctgctctgcctctttgatgatgttatcatacactttggaacgatggctcatctccataacagacattccactgccctgatagtccaacatctcatctgctgcttccttcaatacttcctccggcagaacggctggtcctgcggaaaaattgtaaactctgctcataatcattactcctcctgtttctttttcaagtcatccccggtaaaagcagaactgatcgcttcacccggagcaaccatcggccataccttgtcatcactatttatgatacagtctattacaaccggggtatcagatgcaagtgctttcttcagagctttgttaaactcttcacgattcgttgcccgatagcccgttgcacccatggcttccgccaatttcacataatctacaccgtcatctaaaacggttgcagaataacgtttctcataaaacaaatcctgccactgtctgaccattccaagtacatggttattaatgatcacttcgatgagtggtaatttttgtctcactgcagttgcaatttcattcatattcatacggaaacatccgtctccggcaatattaatgacctgtttatccgggcatccgatctgtgcaccgatcgcagcaccaagaccataccccattgttccaagaccaccggatgtcagaagtgttctcggttttttgtatttgtaatactgtgccgcccacatctgatgctgtcctacttccgtcacaatgatggcatccccgtttgtctctttatagatatcctcaatgacataaggacctgataatccggtttttggataagtcagtggatactttactttgtaatccatgatatgtgtgatccattccgtatggttcatctgtgtcagccgctcattcacacgaagcaggatctctttgatatcaccgatcacagatgcatctgtctggatatttttattaatttccgcaggatccacatcaaactgtaaaatatctgcctgacttgcaaatttctttgcattgccaagtacgcggtccgaaaatcttacgccgacagcaattaaaagatcacactcactgacaccgagattggatgcttttgttccatgcattccaagcattccggtataaagatcatcctctccgtcaaaagctccttttcccatgagggaatcacagacaggcgcatctaccattttgacaaatttctttaattcctcactggcgccggagatcacggctccaccaccgacaaatatgtatggtttctttgccttctggatcatcttgaccgctttgcttaagtcttcctctgtgatcgtctgtgaaattcctgcgatcacttccggctcttttgccttgtattccgtctttgctgccgtgatatctttcgggatatccacaagaaccggacccggtcttccggtctgcgcaattttaaacgcacggcggatcgtgtctgccagtttatgaatatcctttacaataaagttatgttttgtgatcggcattgtgattcccgcaatgtcgatctcctgaaaactgtcttttccaagtaatggaacatttacattgcaggtgatcgccaccactggaacagaatccatatatgcggttgcgattccggtgacaaggttcgttgcccccggtccgcttgttgcaaaacagactcctacttttcccgtacttctcgcatagccatccgccgcatgggacgcaccctgctcatgggaagtcagaacatgtctgatttcattctgatgtttgtataattcatcatatacatttaagatagcgccgcccggatatccgaatacagtgtcaaccttctgttctttcagacattcgatcacgatctgcgcacctgttaactgcattctctaaatcccctttcgtgtttccatatctcattgcttcacgaatgctttcaaaatccggaaagcacccatgaacagcctttctttaatcattctttcccggaatctgtaagattgctccgcggttgccggatgttaccatagatgcgtaacgcgcaaggtagccggtggtaacttttggttctcttggctgccattttgccttacgtgctgccatctcttcatcggatactgcaatatccaaggtcatctcagggatattgattttgatgatatctccctcttccacaagagcgatcggtccgccgactgctgcctccggtgacacatgaccgatggaagctccacggctcgcgccggaaaaacgtccgtccgtgatgagtgccacggaggaacctaatcccattcctgcgattgcggaggttggatttaacatttctctcatgcccggtccgccttttggtccttcgtaacggatcacgacaacgtcacctgccacgatctttccacctttgatcgcagcaatcgcatcttcctcacagtcaaacactcttgccggaccttcatgcaccatcatctcatctaccactgcagaacgttttacaacgcctccatccggggcaagatttccttttaatactgcaagaccacctgtcttactgtatggattgtcaaccggacgaattacctccgggttcttattcactgcatttttaatattttctccgactgtttttccggtaacggtcatacagtctgtgttgagcagtccaatgtctgctaactctttcataacggcatagacaccgcctgcctcatttaagtcctccatataagttggtcctgccggtgcaagatgacagaggttcggtgttttttcgctgatcgggttagcaaaagatatatcaaaatcaaatcctacctcatgtgcgatcgcaggaagatgtaacatactgtttgtagaacatcccaatgccatatctacggtcagggcatttaagattgcttcttttgtcatgatatctcttggacggatattcttattgtacatatccataactgccattccggcgtgttttgcaagtttgatacgctctgaataaactgcagggatggttccatttccgcctaatcccataccgagtgcttctgtcagacagttcatcgagtttgcggtgtacattccggaacaggaaccgcaggttggacaaactttctcttcgtactcttttacttcctcctctgtcatcgttcctgctgcgtaggaaccgactgcctcaaacatagaggaaagacttctctttttgccgtgcacatggcctgcaagcattggtccaccggatacgaatacagtcggaacattgattcttgctgctgccatcaaaagtcccggaacgtttttatcacagtttggaaccatgacaagtgcatcgaactgatgtgcgagtgccatacactcggtggaatctgcgatcagatctcttgtgacaagagaatatttcatcccgatatgtcccattgcaattccatcgcacactgcgatcgccgggaatacaaccggcacaccgcctgcctctgcaacgcctaatttcactgcatttacgattttatccagattcatatgacccggtacgatctcgttgtaggagcttacgatacctaccattggttttttcatttcttcttctgtaaagcccagtgcgttaaaaagacttctgtgtggagcctgctgcatccctgattttacattatcactcttcatattctatcattcctttccctcacctgaaattatcattcagcccggatattcctcctcaggtgataccattccatctttctgtattaaatacgctcacagatcagatcgcccatctgtgatgtgccaacctgtgttacatatgctttctttgcatcttcctgcggcataatgtcgatcgtgcggtaaccgtcttttaacacctgtttgacggctgcttctatcgcatctgcctctttatcaagatcaaacgtatagcggagcatcatcgctgcgcttaaaatcgttgcgattggattggcaattccttttcctgcgatatccggtgcagaaccgccgcttggctcatacagaccaaatttggtatcgttcagacttgcggaggataacattccgatagagcctgtcaccatacttgcctcgtctgataaaatatctccaaacatattctctgttaaaatgacatcaaactgttttggatctttgacaagctgcattgcgcagttgtctacgagcatatgctcataagtaacttccggataatcctttgcgacttcttccactacttttctccataatctggaggaatctaaaacatttgccttatctacgcttgtcactttttttctgcgcttcatggcgatatcaaatccgcgctttgcgattcttctgatctcgttttcattgtaagtaagtgtatcggttgcagttatcacaccatcaaccatctccgtctttctcgccccaaagtaaagacctccggtcagttcgcgcatgatcatcatatcaaatccatctccgataatatcgtcacggagcggacaagcttctttcaattcttcatataaataagcaggtcttaaatttgcaaataaattcaaagactttctcaattttaacagtcctgcttccggtcttaattccggagccagtttgtaccatggggaagtctgtgtgtttccaccgatcgatcccatcagaactgcatccgatgcctttgcagctgcaattgcctcatcggtaagcggcacgcctgtcgcatcgatcgaacatcctcccatcagaatatcctgatacgtaaacgaatgtccgtatttctcccctgctttatctaaaacttttttcgcctctgccacgatctccggtccgattccatcgcctgagatcacaccaatatgacactccatatccaatccctcttttctttcaattcacagcctgtctgtgcacctctgtgaatccgtatctttttcactttagcacagtaattgccgacagtatttataaagactataatatagtatctttggaaacatttcaactatcattgctatttttctttttcataatagtcataactgttacctatagaaaatacagcttatcattcctcacatacataatgataaacactttcgtataattctgtgcgcacgctctgaaactcatcctctgaaagcggttccggtgctgacatgatccgcagggggatttcatgccggtcttctcccatcggcggctggatatatggatattcgttaaaagtgaacccatgccgctcataaaatcctattcttctttttttcagggaatcctccggcaattccacctccagaacaacttttcctgctttctgccttgccagttcctctaacatttttccgccgatcccactgtttcttgctttctcactgactgcaaaatgctcgataaaaacaaattccgcaaactcccagactgctaaaaatgccagaagccctccctcgtttcttacaccgagcagctcatatttttcttcatccagaagtttttgctgcccttccttttttcttctctcatctgccggaaaactctgttccataatacgataaacttcttcaaaatcacttctatccagcttttcaagacaaaccattttctttccctttcatcatcatattttgatccggatcatgcgtgaaacagcagctccataagcagcccgcttccctgatgctctttcagatacagataagacgccggcaactgccgacgtcttatgataaagcactctatttacattatgcttcttccggtttttcaactgctgcaattgcagatttctgcattgggatacggcagttcttgttgcttccaaactcaacaatgactgtatcgtctgtgatatcaataactgtaccgtagaagccacttgttgtcaaaacagtatctcctgttgcaagttccgataacattgcatttttcttctgagtctctttcttctgtggacggatcatgaagaaatacataaatgcaaataaaataactaaccaaaggatcattccacccattcctgctgcggatgatgctcctgatgatgccaagattgataacatctttcttcctcctaaaaacttattgctctctaatatcgtattttgatatttttagaaactataaaacattgtacacaaaaccttgcgtttcggcaagcttttccaattaattttataaaatatttagtcttagacaatatctgtccttttaatagaacttcttctgtccgctcatttctttttcacggtcgatctgtcccatgttataaagtttttcttccttatacgatctgaagtttccggcatcaagcgcatcccggatctcttccatcatcgtattgtagaaataaagattatgcagtacacacagacgcattccaagcatttcttttgctttcagcagatggcggatgtatgccctgctgtatctgcggcacgccggacactggcagccttcctcgatcggacgcatatctttttcatatttctggttaaacagattgatctttccctgattggtgtatacatgtccatgacgaccattccgtgacggataaacacagtcaaagaaatcaataccgcggtcaacgccttctaaaatatttgccggagttcccactcccatcagataagttggtttctttctcggcagataaggaactgtctcatccaaaatatagtacatttcctcatgtgtttccccgactgcgagacctccgactgcatagccgtcgagatcgagctccgagattctcttggcatgatcgatacggatatccgcataaatcgcaccctggttaataccgaagagcatctggtttttatttacggtatcctctaacgaattgaggcggttcatttcttttttacaacgctccagccatcgtgtcgttctcgctacggatgcctccacataagggcgttccgcaagagccggcgcacactcgtcaaaacccatggcgatcgttgagccgagatttgactggatctgcatactctcttccggtcccatgaaaattttggctccgtcaatatgagaatggaaataaacgccttcctctttgatttttcttaaaccggcaagggaaaacacctgaaatccaccggaatctgtaaggatcgggcggttccatgacatgaatttatgtaatccgcccatctccttgatgagtttatctcctgttctcacatgcagatggtaagtgttcgataattccacctgacatttgatctgttctaaatcctcagtggagacagctcccttgattgctgccactgtgccgacattcataaacacaggggtctggatgtctccgtgcaccgtgtgaaatactccacgtttggctcttccctcttcttttaataactcgtacaatttttgtactcctttcctgtttccattatatttaggcgtttgcgaaactcatcctactcttctttcaattgttcaaaatcaacaaaaacattcaagacacgctctcgctatgtgtcactcgcaacggtactaagaagccagttacaacttacagttgtacctgccttctaagaaccggcggttccccaatgtctttcatgtcttttgttaatttttcacaatttaatttaggttttcaagagtttcgcaattgtctattccgttatattagtaattgcgaaactcgattttacgttatgaatattacgaaaagttaacaagatcaacgaaaacacgcttccgctacgtgtcactcgcaatggtactaaaattctttttttcattgtatatgatcactcttgagtcaatattgtaaacagttcgaaataattttcgaatgtttttttgcagcatagcggatcgtctattatgattccgtcagtccgtaaaccaagcagcgaaaatgccattgccatgcggtgatcttcatatgtttttatcacagttgcatgtggcactcccggataaatggtcaaagcatcttcttcttcctcacaccggataccggcacgccgcagttctgtcacgatcgcatggatcctgtcagactcctgaagtctgatgtggccaatgtgcgaaatatgcaccggtgcatctgcgtatggcgccatcgccgcaagcgtcatcgtctggtcagaaaaatcgttcatatctatatcgattccatgaatatttccatgttccgggccttccacactgatcccttttgcggtatctgtcactttacagccgagctgctccaacacctttaaaaattttttatctccctgcgtgttgtccatatgcacattttcgacgatagcttttcctccggtgatcgctgccgcaccataaaaatagcatgccgccgacatatccggttctacgatgtaagtagttttatgataagctgcccccggcatcacctcataattttttccatcaaactgtgtctgcacaccccagttttccatcatattgcgtgtgatccggatataagaaccatccgtcttctcgcttgtgatctgaatatgcagcccctgcggaagcatcggcgaaatcaaaagcatggcactcaaaaactgggtactcctgctgatgtcaagccggactgtaagcttctgattctttctctgcccattaattttcacaggaagaaagccttcccgttccagatatgtaatctctgcccccgtctgctccaataagtcaaacagatctttcatcggtctttttttcatctgcccggatgcctggatcacataactgccatctgacattccaagcattgctgtcagaaatctggcggctgttcctgcacttccaacatcaatctctgcttcttttttcggaattgttccgctttctccttttaccgtcacacgccttttttcctcttccacgagaacatcaaagcccagcgcagtcagtgagctgataaaatgtctggaatcatctgaaaaaagcacgccgtctaatgtcactgtcccatccgagagtgctgccattaaaagcgccctgtttgtcatgctcttagaccccggcactgtcacgcaccagtcgatcggtttttctatttttctcacagggtattgttccattcttggaatctcctcacaaatttttttacaactttttatattttaccatattcttattgtcgcgcaaagcgaaatcttttataatcattttatatttggtgataaaggagcacatacctatggcaggatcaacatttggaaatatatttaaaataacaacctggggggaatcccacggaaaaggagtcggtgtcgttgtagatggatgtccggcaggtctttctctctgtgaggaagatatccagaaatttttaaatcgcagaaaaccgggacagtccaaattcactaccccgcgtaaggaggatgactccgttgagattttatccggcgtatttgagggaaaaacaaccggaactccaatctcacttgttgtatataataaaaaccagcagtccaaggattacagtgaaattgcatcctattatcgtcctggacatgctgattacacctttgatatgaaatatggtttcagagattaccgcggtggtggccgttcctccggccgtgaaacaatcggacgtgtggcagccggagcgatcgcagtcaaaattttggatcagcttggcatcagacttatgacctattctaaatccattggtccaatcgcatgcgatccgcgtcatttcgatgccgaagagattctgaaaaatccggtgtacatgccggatgccgatgccgcagaaaatgcaatggcttatctggaagcctgcatctctgaacaaaattcttccggcggtgtcgtggagtgtatcatttccggtgttccggcaggtatcggcgatccggtctttgaaaagctgaacgcaaacctcgccaaagccgtcatgtccatcggcgccgtaaaaggtttcgagattggagatggttttgacgttgccaaggcaaccggcaagaacaacaacgatgctttccgcatcggaacggatggttctgtttccaaagaaacaaatcacgccggtggtatcttgggcggcatgagtgatggttccgatatcattctccgcgccacgatcaaaccgacgccttccatttctgccacccagcacacggtcaacaaatccggcgaagagatcgacatcaatatcaaaggccgtcacgatccgatcatcgtaccgcgtgccgttgttgtcgtggaatctatggcagctatcaccatcgtggatgcgatgtttgcaaatatgagtgcacgcatggattcgttagagcggttttacaaataaaccggagtttaattggcgtagtgtcgcagattctgtggtgcagttcctaggttgtgaagggcaaatataagcgtcctctcacaagacatgattttataggtttatgaaaagaaaaacggtgcagacgaaatataatgttcctgttcgccggacattccgataagcctctgaagagtcttatctccatggctcacaaaggaaatcatatttgtctgtaccgtttttctttcatttacattatggatgacttgtgagagaacgcttatacatgcccaatttacgctgtgaagcgcaccatagaatctgcaatttacgttatggaactcacggttatgggatgagtgcctataaaagaggtagaataagctgctttgacttcatgaatattgtttctacaataatcacaatcacataaatcttcacttcttatttgattgtaatatgatttagctttctcaacatccaaagtgtttacctcctaaaacttgaattgagatttcacctgttttaagagatttaataaagtgtaccctttgtcaaggacactatgacttttccttttcagatttctattttatatttgtttgttgtgtagaggcatcaaagtgatgcctctgattgattgtttttaccttttgctttagggattatcagtggataaattcctgttgtcagatattgataatattcaacaggtgacaaccttgctaagtcccattgataacgttctgtattataatattctgtccaatccctaactgcgtttaatatctcctcatagccgtggcactctgatagatctaattcatctttcatatgaccaaagaatgattcctgaggagcattgtcccaacagtttgctctacgtgacatagactgtctcagttcgttatcctttaacaattggataaatttaatgctggtatagtgggaaccctgatcgctatgtattaatgtttctgtgcttaaatcagttccatgtttttctattaactgctttactgtttctaatacaaaatcaatttctagtgattcgctgagaacccatgacagcagttccttggtacaggcatctataattgtcgacatatagcaccggggtgcttttccatttataatatacgtgatatccgttaacagaatttttcttggtccgtgttcctcgaattcacggtttactatattgggtgcggtatatgcagttgccattgcttttgccattctccgatagggatttgccttgcggatagggcactgtaagttgtacttcttcatcaaccgccggatttttttgatattcatcactatcggcggttccatgtgtaacagcctcatatatatgctacgggcacctttatgatatcctcggtactggtatgctttcagaatcagaagaaaatcctgtctgtcctgttcctccctttccattcgctagtcttctgttgagagataatggtaatatcccgaacgggatactcctgcaatttcgcacatggcagctacattcaatagattatcgtttttttgcatggtatcataaataatctgatactttgcatgggctggtattttcattattccggagcctccggatttaaagatacaattttttttagaaactcaatctcctgatctttatatgccagttgcatttctaaatattttatccgattttcagccgaaagatatccgttgcatccctgtgcataggtgttaagatctcgaaaaccatttcccttttttacttcatttccaatcatggttttcagaccatttattctggaatcccccaagatatttggatctatcccaagagtcgaaataatctcacgtggaagcctgccctttgacagttcctcccaaaacagttttttaaattctgccgagaaatgtacaatgctcggtgatacatccagcacatatttgctatttctcagtgtgagcatttcctgttctgtaaactttctgtttgccataatttcctccaattcattattattgtaatatcaatctgaatcggagtcaaaaagcgattttgtccaaaatgaaggggttcatcaaaaccatgtccgaagttaagggttccctgtaaactcattgtatagatttaagggttttcattaaaacttactgtctaatggtaagggttttaaaaactcaatctgtccaatctatagggtacattttataataactgttatattttgttattaaattctccacaagcccttgaaaacactggatttatcgcaggtgagcttttccttattgtttcccttgtgttatatcgtcccatcagtgtttacgaactctgataagggcaaatacaagggcaagaaaaatctataaaacagtataacacaaaataaaagtgacatggtgaactgattgaaatgcttctgatttttgtaactgataattgattgaatgataaggagagataagatacgatgagaacaatatttgcagaatacaatccacagcgcaatagtattgatgtttacacctctgctggctatatgctccgcattgattgctgggaagctgaaaagaatttaaaaactacacccggatcagactgtgcattaaacgcacttgctattgatgaaccacttgaatatgtacgattatatttggacgggaatatgcagatgtgggtagatgcagaagattcattagaactatggtgatttttcgacggtgtgaaattttttctgtaaattcagatcttctatgataattgatgcggcttaacagcagttttctgttgttaagccgttgtttatttaatagcaaaaataagccggtatgtcaagagcacccagaaaatctgaacgtacatttactcttgatcatccggcttattttcaacagcactacgattaccttttttaatattgtttgggatactccctccataaccgtcacagcaattttatactttacttcgatttcaatcttttctggtggattggctaaaagcctgtcaatatcattttcctcaacaccagccatttttgctatcgttagcttggatatgccatgataggaaacaagcacttccaaaaaaccgcttaattgcctatccttcccttccaactgttcctatatttgaaaaagagattcccataaatccacctcacggttcataaataaatctatctataactttatatctactgactttctgccactctactctctggtgatgccatcctatgcaccaatttgatatttcccttttaccgaatccttttatgccttaacatcacaacttcctccgatagatggagctgtacctactgcctgtgctacaacattctctgtaatgcttttcatatccgtaccaattgcaaatattgtgcgtctatcttcctgaattttcttcatctgctcttttctttcagctctccgttctgcaagtttttgttcattttctttctttttctcgatttttctatcttcatcagcctttttttgttcttcgcttggtcctgtaataaccatggagcccatattaccatccttatctatccatacctgacgatacttaacttcactaccagtcattgatttaatcattgagtcagcccatctatctaatgctggaatttttgacaacatattttcatattttgtggcaacctctggattactcatcatcctatttaaaatctcaggagcaatcctcacatctgtttttcctgtacgattagctgtttttacatttttatccgaacttcctgccacaatatctatttgaggatttttttcctgcaatttttttacataatcttcctgactctcttctgttttgctcacctgtgaattttcctttgttttttgaatatcacaagctgcctttttaaccgtgttcttgtaacctgatgcataatacgatgtgtaactgctgttattgatacctgtaattgccataatcctacctccctgttattgaaacttaaaataatttctattatattgaacgacttggatatttaatttccgttgatgtaaattcatcttctgccgaaacattgatatgcccactgctgtcaatagcatactctttaccataaacggaaaacgtatctccttctttatatccgatttctatccagtttatatcatttaactgttttatctttgcgtcaacatttatggtctttcctgattcctgcaataaataagtgtgttttcctgctcccgcatctatagaaaagaatcccggagaaatcctgactttctcacagacggacaatacctcctcattgctgtagagatacccccacacactctttccctgtgccagatcagacaggatattgcctgccttacacatttcccacttataatttgttcctttttgatttgtattctctgcaagcaacgattccgaggctgcccagcctatccttccattgttgaccgtccatgtatatttaccgccacttgatgttgtccatgaataataacttttattacttaataccaaagaattatttgcagcacaaatgcctgacatggtgcttgtattcattttcggtactgcataattaggtactacctgtctgctcccattaaggtcaaaggaaataaccccatactccttaaaatcagaattatatccacaggaaacattctccccaaaattgattgcatccaaaatagcacttgaattattatagtttgcaaaataataagccaattcactattagaaatattcacatttttatctatcagtgcagctatggattgctttgaaaagcctcgtgcagcatcagaaatacttaaactgtcctgttttttattatttcctgctccaagcaacatctgtattgctttttggtgtattcctgcctctgcctgttttgaatatgtcaatagctggtttactgtgtttacatctgtcactgtcctcataattattccaaaccctttttcaacattaaacgccaaacatatgctgcaatttgtccagcatatcatttgatttttctctaacacttcccggctgatttcttaattcatatctgttttcatagtaatgattcaagtaacctttcagcccatcataaaacgaatccttatctatttcatcacttaaaaatttgtcgcacaaaccagtcatttccgttttctcattcgtatagaaattcttctcatcggagatgatttctgacttgtacttataagtttctgttttgctccttattccgataaccatataatccggtgtcattctctccatgatagaattgcgtgctgactcattaaaatgaacatattcgtcaatcatattttgaaaactagtctgtaattgttctgggatatacattttatttattttgtttaatccagcttcacttgcacttaataaaaataccgattcaaatgaagtaccacgatacccttccctcgcattcaagtcatctaccgctgccaccattttgtcaatctgttcttttagtgtatttctttcatcttctgataaatattctgctgcattttcatctacccacttttcaaaaaccgaaacctcattctcagaatgtccttcaaatacacttttatctcctgaaatagaagatgtctttagttccaatttaaacaaattctcacatttgtattctgctggtatttcttttatctctccattgattgatgaaaaatgcattgcctgaaaatctgagactttatcacgagcagtctcaactaactttcttgctgaatcactgattttcacatcatcctccgaaataatattctgaggaacagttgttttcttctcgaccttattttttatcatctcaggattattaagatacctatttccttgaactttcatagcaacctccctaagttagtccacactttctatacttctttatctatcttgctcgatgtcaaagaagaatccgtcttagagtatgtaccattatttgtataggttgcactcgcccggtttgcagcattcgatataccagttgctttctgcgatattttgcttacaaaagaattatatcctgtaaagatcgttttcagcgaactgatatctgcctgctttaaagcaccctcatctaattccaacttgtttccttttcctatggtaatacctattttggcaagcatattactgtttttgtctgtcattccagtcatccatgaagcatttcgcaatacatcctttgtattcgattctcctgcttccctaactacatcattataatcttcaacaaaagattttactgccttggtgattttatcccagtcataatcctctaccgcaatctcttcccccgttttttcatctttcttttttattttctttttttcccaaagagaagagtcattcaaagcatctgctgattttttcagggaatccgcacttgttttcatcagtgtaagcttctgtgaagtatcgcctttacccgataatttttctgcatcctgctttgcataatatgctttcataagttttccatagcttccgtttttaatcgcagcataatcagaaagcatattggtgtttcctacggatgaactgtcggaagttcctccaaataatgcggaataatctacattgctgttatatttacttgtgtaatcactaaaactcttaatctctgacataataccattctcctttaccaactataaacgaatatcaatcggtgtatatgtcacctgtgtttcccctttgatatccgtattctttacgctgtctgtctcctctgccgcagcccccgcagattcctgtgttttctcggatttatcagtattgttctttgttgcagtgtcttctgtattgctgttctccgcttttgcagcttcttctactgatttatttgcatctgcaagtgtagacatctgtgctgctgtcgcagactgtgcctttgcctgcagctctgccagttcttcttccttcttctcagtatttccttttccggcatcctgtttgatttcagattcaagcacactggcacgtccctgtatctgtgttgccatacttccctgcacctttgcctgtttcatggaagaatctgcggagatcatcgcctgcatacttgcctgtgacaatccggtgtctttctttttagaagtgctacttgttccagccaccatatcatccatagatgacgaatttttactctgctgttcctttctctgctcgatctggtgctgtcttaactgctgattgagattgttaatctcctgctgtatctcctgacgctttttcatcttatcctctaatgacatttcttcattcgatgataaatcctgtagcttctgctgtgcatttgcaatctgattctgaatatttttacttacagaatcattcccctgtgtcattcccattgttcctgtctgcgtatttgtcccactaaatccattgattctcattttaatcctccttgttttgcgaagcaaaatccgaaccctttggtgaggagaggatttggcctccttgagcttaaattctgaaatccgtttccttaaaaatctgtacaacatgatttctctttactgatcctttcggcatatctttctttacaataaacagcgatgttgtgaaccgccctttttttgttgtgaagcaaataaaaaacacctcgaaggtgctttttgtccttattctacctgtaacataatacttagaaccacttcctgattctcctgctctaaagatatatctcccatatacatccttgcaacccttcggatattatgcagtccaattccatgctccttcccggatttcgttgtttccggcagatcactgtccttataatttaactctccctcatatctgttctttatggttatcataaaaatactgtttttccgaaaagaagagatacagatataaggattttctccacttacattttccatgcaattatccagtgcattgtttaagatcacgcttaaatcaaatgcatttaatttcgtatcccccggataatgaaaatctgatataaaacgaatctgcttttcctttgcttctcttaacttttccatcagaatcacatcaatgacaggactccccgtttttatctcaggagatatttcattccactcctttttcaaatgctccatatattctgctgcatcatccatatgattctctgccacaagatgttccaacatctgtatatgattccccatgtcatgacgcaggctgctgatatcctgatacagcttttccacttccccgatatgctttttcatgtcactgacctgatttaataccagctcctgccctgtctgttcttcctgtgccaccttccagttttgaaacatcgttgtcataacaagaattgctatgatagagataaaataatgcacaaagcttaaagctccataaaatccataggtatctgtcaggctctttcctgtatctttttcataaatattcagataatattgcagaatgccatatcctgtaactcccacaagagaaggtatgatgagcattaccagctctttaacgttcatttcatcatttttgtatacatatgctttattgatcagaccgattgcaactgcaaggaaaacgatacaaagcacaatatccagaattctcgttccagcataaagtccatattgcagccattgtcttcctgcaatcgtattcccaaaaaccaaagcttttgtgataaaatcatccagtctgtctgccattgcaaccgcaagccaacggatagaaaaaaatgtcactgcaagaaatattttctgatagatgtttcttctgtcctgtacatacatcacaagaaatgcagccacaactcccagcatatatgcagaaaaattgccaatctgctgcggtatcagatacagcacagacataattccaatataaacaatactgaccagagcagcttcccttttctttttcatatatggatatacaaaaacaccaaaacagattcctgtaataatcaaaattgcaataacagaaaacttcgatgtgatcatccagcatctttccactaaactcatctgacttcatttcctttcctctggttatacttcagatattgcttcacaaactccggataattcttttttgcaatcaatgcagttccatttttcatagttacacaagttgcatcatatttttctacatatttaaaatgtacaagataggctctgtgtgttcggaaaaaatctgttcctgccatatcacttaattcctgtaatttaccatagtattcaatatccgtacttcgtgtatggataataactttccggttatacacctcggcatacacaatatcacgcagaaaaatttttatatgacttccggcggtctgtaccatgatatatttttcgtctttttcaagtctggaactcctttttatgttatggactgcctttgtcacaacctctttaaatttctcatcggaaaatggcttaaccagataatgaaatgctccgacatcaaatgcctgaaaaacatattcctctgctgctgtcacaaaaatgagtatcatattctcattgtcctgacgaagcacctttgccgtttccataccatccattcccggcatctgaatatccagaaaaagaatatccggcttactgccacttgcgatcagttcatcacccgataaatatttatctataaccgcatccggcaataacttttttattttttcttccagtatctgaaccatagatacttcatcatcgcagatagcaattcgcatattgtcacttccttgcttacatatatttatagctattatatcggataagttcatgcaatatctatctggaatgttgtgaattgacctttttttgttgtgaaaaggtcatcaatttatgctaacaaatttgtaaacatgaatagaagaacatagtaatccatataatctgtcttttcatcaatctttctctgcaactctgctttccttgtgagctttgccaaaccttttaaatctgacaattcaatctcaaaattacctctttgctgttctgcctcaaagataagtttattctgattatcaagctcttcctttatcttctttaaattggtataatcggctaccactggtgtcattacaggcttacaattatctcataagggcaaaaataagggaaaatacatatcatttcactaatgaacaggctggaatgcctgtaaaattgggaaagttagccagatatttcggcaaactgttaaggaaacaatcggagttggtgtaaacgaaaaagcagccttgagttctgataaaagctgccctttcgtttacatcaatttcgattttaccttggtgaacaaagtcgcgtccctttagccgatagctatggggattcaatcgttgctcttttccttaagtttatcataccggatgttttggtaaaagtttttttattcaagaaatcaatttcaggcatgacaaacaaacctcctatgaggaagtcatttattctatgcaattgtagatcttaacatctcatatgtgcacgaaaagaagaactgtatttatctttgcggggtgataccatattccctccacaagaagaacatttgcatacatcgatgtgatataaaacccttatcatttctactgcatttagattttttaatgtagaaatgtatttcttacatccaagcaggtttctgcagtgagttatctttttttctcttgtttctacatgatagcagaccatagtgccggattctgacaaatcgtttgggaggaacatgcatcatgaatcgacggatgaattcttctcctgaaattgttttctctttccagcagccttcgtttttatagtcttttactacatatgtaactgtcgtatctgtcatggatttgattcgatgattactgattgctatcctgtgggtatattttccaagataattgataaccgactgtgcaccattgaaagtttctttacagtaagtgacccagttcttttcataacacttatcaagaagttctttaaaacgatagctgttctgatatttctctgctgtaccatgaaatttaagcttagaatcattccacaggctttttaactcatccagatattttccacggaacactttcgagataacaccatatgggagaaaaaattttccacctgtttctttccatttattttcatcatcaagcccacctccaagaacaatggtatgaatatgaggatgataattcattgcagaaccccaggtatgaagaatgcagatataccctatattagctcccaggtactttgcgtcttttgccaattcattcaaggttgctgaggcagcatgatacagtgcatcatacaacagcttctggttgctgtaaatgatggaattcaattcctcaggaactgtgaatactacatgataatagggtgcatcaagtacgttctctttttgtgcatcaatccatttctctttcggaaactcctggcacatgggacagcatctgcttctgcaggagttattatgaatgctgatacatccgcagtcctcacaaacactgatgtttacaccaaaagcgcctgttttacagttcatgatatgataagctgtttttctatgatgagcaggagggctattcctcttttcataagaaggataaaaccgttcaaatacatcttgtatcgtacatgatttctccataatcattcaccgcccatctcatcaaatggactcctgattccaagcagggttttattgcttacatgcagataaacctctgttgattttggatcacgatgtcccagaagcgcttgaatatattttacatcacagccggattcaaacagatgacttgcaaagctgtgacgtaaacaatgcgtggagacgtgtttctgaatgcctgctcttttggcactttcacgaaaaaactgaatgacactatcttttgtaagataatcccctgtccatgaacttgggaacaaaatccctcttggtctgccacattgaaaccagtattctgtcaatatctcgagcgtccggtctgcaagcaaagtataacgatcagagcgacttttcccatcacggatgtgtatggttttgttcgtgcgtgaaatatcatcataatgaagatgtgtgacttctgaaacacgaagtccgcctgaatacatagtggcaatcatagctttgtgcttcagatttggcgtagcatcaagaatagctgatatttctgtttttgtaagcaccgttggtaactttctgtcccttttcatacgaggtatgtcatcatcatcccaattcttcttcaatatttttttgtaaaagaagcggattcctgaatggtagtgattgtatgtttctggtgaaatcccggaaagtttcttttcagttaggaatatatcaacatcgtcagttgttaatgcatctatatccttggctgtgtggttcaaaaaatgagcaacactggtacagtatgcatgaatcgtggaatccttgagattccgtttattcgcagcagattgaatctgattaaaaatttcttcgtacataataaaatcctccatgtaaaatcagtagttaatgaaaaaccctgcttacatggaggtgcattagcataataaaaccgcttgtcagaaaagcggtcaaatggtattcttttcataggcagtggtgtctttctttattgaattgttttgtgtggtaactttacaatatcaaatactggtaagaattgccattgcctattttattattgagaaaaagaaagctgcgccacagccttggcaggccatcgcgcagcgattttgttcaacttgaagttgtcttacttcttgtcattgaagtagatgataaaagcacccattactgcaatagcaatgagcaatccaaactcatcccaattacctaaaagttcaagtcctacgaccgtacctaaataaccaacaatcaatgtaacaattactgccaaaatcgctttacccatataatcacactcctttgtcaacttccgatttctcaacttcattaatatcattattctaccataattacacttacaatcctacttcattctattaaaattgatttacagaagttataattaatttactttgagaatgcagattaatttttgccattccctcataggcatccatcccctaaccgtgagttccataacgtaaattgcagattttgtggtgcgattcataacgttgattgggcatgtataagcgtcccctcacaagtcattcacagtgtaaatgaaagaaaaacggtgcagacaaatatgatttccttcgtgagccatggagctgggattctaaaaatttcgtgaagctctgcttcacaaaatttttgctcagaagcccagcggaatgcctggcgaacaggaacatcatatttcgtctgtaccgtttttcttttcataaacctataaaatcacgacttgtgagaggacgcttatatctgcccttcacaccctaagaaagcaccacaaaatctgctactccacggtaagttaaactccggttatgcttccagtttcaaaatataaatgcagttcggtttgtcaaccttgatcggttttccttcccagatagaatatttcttctcgtagtccactgcataaaatgcaatatcattggatgcattattcagagtcagataatgtttttcatccgggaagattgcaagcatcttagggaaatcactgcagactcttgtctggaatgtgacggtaagagttccctctttttggtcgatcgcatagcagataacagagtttacaccggaattacttacatataaatactttccgctcttggaaacttccataccggatgctgcgcagacatcatcatcttttggtcccattgtggtgatcgtctggattttttcaaatacaggcatgtcatccacaatcttataactgtacacttctacctgattcagcaattcgtacagaatatatgcaaatctgccgtctctggagaaacggatcatacgaggagctgactccagtggtccacggataatatcgaccagctctaattttccgttttcataatcgacacggtaaattttaacctgatccagaccattatcaactgcacagaggaacttctgatccggagtcaattttacgcagtctacatgtggtataaaattacgctgtgcaatacttcttcccattcccttgtggaaaataccatctgcgatatcaccaatacttccatcttcattcagacgcatcatggtaacacgtccatcatggtgtccgcctacaaaaagataacggttctcatcatctacttcgacataacatcctctcataccaccaatccactgttcgttgatcggttcgagatccccgtcttttaaaattttgaaagcttccacaccttcatctgcaatagaataaaggaattttctgttcttggatacaacaagatcagacggattattgattggaacaactttgcgttccttcatataacctttcgttacatcaacatcataaatatgaattcctacactgttctcatgggtataggtgcccacatatgcaacatatttttcctgtgccatactcgtaaccattcctttccagtccgtttattgtgattcagctccatgtaaactgctgaactgtcactcctgcctactcttttctgcgtaaaatatcatacatttccaatggatgtcccagatcaatatataatacctgttttggatgcggcgcagattccatttcattgccctcttcatccacaatgcgttttaccgtaacttcaatattctctccatccggcttcatcacttctatttgctcaccaacggaaaacttattacgctgttcaatacgatatagcccttcttcatttgtcccgcccacgataccgaggtatgtgtattctttcaaataagtattgttatcgtaaatctgcgcttcatccgatggctttccgtaaaagaaaccagtggtaaactgacggtaagtgcagtttgagatctgatctaaataccatggcatattttgctgataaagctccggtgatttcttataatcatcaattgccttacgatatgttcttgccacagtcgcaacatagagtgctgtcttcattctaccctctattttaaaactgtcaatacctgcatcaaaaagatctggaatatgttcgatcatgcagagatcttttgagttaaaaatataagttccacgctcattttcatataccggcatatattcatttggtctggtctcttccacgatggaatacttccatctgcacggatgtgtacatgctccctgatttgcatctctcccggtaaaataattggaaagcaggcagcgtccggaataggaaatacacattgcgccatggataaatgtctcgatctcaagatcatccgggatatgttcccggatctctttgatttctgcgatcgataactctcttgcagagacgacacgctttgccccgaatccataccagaacagataagtcgcatagtttgtgttattcgcctgtgtgctgacatggcgctcgatctcaggacagacctcttttgcaatctggaatacgcccggatccgcaataatcagcgcatccggttttatttcccttaactctttgaaatattcccgcacaccctcaagatcgccgttgtgcgccagaatatttgcagtgacataaacctttacatcatgcgcatgtgcaaattcaattccctctttcatttcttccatggaaaaattttttgctttcgcacgcagtccaaatgcctcgccaccaatatatactgcatctgcgccataaataacagctgtttttaatacttcaaggctgcttgccggtattaaaagttccggtcttctcattccttttgtatccttcctttcctatttcttcacactcacggtaattccatctccgatcggtaacaccgaagtcaccagctcgtcggaatgtgtcagttcgtacagatattccctcattctcttataaatcgtacggtttcttctcgtcacaataaaatgggattcgataatatctccgtcctgcaaaacattgtctgataccagaatcccttccggttttaacaatcttaagatttccggcataaaatggatatactgcccttttgcggcatccataaaaataaaatcaaacggttcccgcaattcttttaagatatctgctgcatccccctctaagagggtgatctgtttttcttttcctgcccgcacaaaattttgttttgcaatgggaattcttttttcataattctcaattgtggtgatttcacatgggattggattgtattcagccattaaaattgctgaaaatccaactgctgttccaacttcaaggattcttgcgggtctttttatcgataagatcagtttcagaaaactctgcatttccttgcgcacgatcggcacataggtttctaatgcctcgcgttctatctcatctaaaatctctgtattcccggtatccagggaattgatatatgttaccagtctctcgtcaacgatcacttctattcctctcctgtgactgtatctgcatctgtctgtgtatcggttgtctcttcagttgtctcttcggtagtgcctgtgaccgtctccgtgtcatctgtagaactctgctccggttctgctgccataagcaccatcatgtctctcgttgtcatggacgtattcaatgtatagacgccggaatgaagcctgccggagtaagcagacacttttaactgtacaaaaaagagctttgcattctccacaagacctttttctttcagttcctttgcgatgtccatgtctgacatgtcgtctgagatctggacgacaacatccctgcccggctctgcatcgacaggtgcctccgtaaatacacgatagccaaaatcatagcaatatgttccaattttcacaaatccgatcaatacaagcaaaatgacaagtattgaaaaactaatgctgacaaaacgaaaaactactttgttcaaattcatctcttccctcatgattcctcaaagccaacttcaaattccagtccctcgatcaaagtccagttgatctgctgcacaattttgcagagtgcattttctgctgcaagatactctgacaccataggattcttccgaaactcccggtactcattctccatgcggtctgtctcttcatacagatccacagttccctgactgttctgcagcagataatttttcttacgaaattctgtgatctggctttccagttttggaaagccatgtaccttttccttaattgcctgatatcggatgaattcctcactgtttctgatcgcagtcattaatccatccatagcatcttctatctgactcatatctgctcccaagctgcttttttcaagtgctttatacttccataataattggcatgatcatcggacgtctctttgtctctttccatacaaaatcactgagagaatctttgatctctgtcttgatcttgccccagtctgtgatgcctttatccatgcagtactgcattctctcatccagtacctgctttgcttcctccatgagtgtctctgcaccgcggacataaacaaatccacgggatacgatatcaggtcctgcaagcacctgtccggagccgccttccaatgtcaatacaacaatgataataccatcttctgcaagatgctgtctgtctctcaatacgatattgccgacatctccgacgccaagtccatctaccatgatcgctccggtatggacttttccggtcactgccgcgctctcctcgtcgagttctaatacgtcgccggaagataagataaagatattgtccttgtcaattccaagttcctctgccactctcgcctgtgcgatcagatgacggtattctccatgcaccggaatcgcatatttcggtctcaccagagagtagatcaacttaatctcctcctgacacgcatgaccggatacatgtacatcctggaaaataacctttgcacctttcatggacagttcattgataatattggaaactgccttctcatttccagggattgggttggaacttaacacgatcgtatcgtttggcttgatcgtcactttgcggtgaatgccggatgccattctcgacagtgccgccatggactctccctgacttccggttgtaataatgacagtctgttcatccggataattttttaactgttcaatatcgatcagtgtgttatccgggatattaatatatccaagttcgcttgcagtgccgataatatttaccatactacggccttccacgatcacttttcttccattcttatacgctgcattgatgatctgctgtacacggtctacattcgatgcaaaagttgcaataatgatccttgaattcttattatcatcaaaaatggcatcaatcgttctgccaacagtcttctctgacatggtaaatcccggtctctctgcatttgtactgtcgcacattaatgcaagaactccttttttaccgatctcaccaaatctctgaagatcgatcgcatctccaaataccggtgtgtaatctactttaaagtctccggtatgcacaacaattcctgccggtgaataaatagcaagtgctgcagcatcctgaatactgtggtttgtcttgataaattccacacggaaacatccaaggttgatatgctgtccgtattttacaactttacgttttacttttgtgagcatattgtgctcttttaatttgtgttcgataataccattggtaagttttgttgcataaatcggtgcatttacctcttttaatacataagggatcgcaccgatatgatcctcatgaccatgtgtgataaaaaatccctttactttatcaatgttgtctttcaaataggtaatatccgggatcacaagatcaattccatacatgtcgtcttccgggaatgacaatccgcaatccacaacaataatactgtcctcatactcaaaagctgtaatattcattccgatctgctctaatccgccaagtggaatgatcttaagttttgaggaatgttcattctgtttcaagtcttttcctccatctttattttttccgctctttttcacttttacagtctctgcagacgcactttttgttttcttctctgctctggctttcttttcagcctttccgcctttttcttctttccctgctgcctcgtctgttttcttctttccggctgttgtattctttcgtgccggtctgcgtgcaggtttcttctctgccgcagcattttccattgtctctgtgatctctttacgattctcttccgcagtaagattttctgttatattttcctgtttcttcaaaattccaattccatttcttaatttactaatattcaatatctgcattgtcaattaattccgcaaacactttaccaagagctgcaagttcgttgtcatcttccaccatctcgtagacaacatcatcattttcatctgcaatctcttttaaaatatatgcttcactgtctccatcctcttcttctgttacaaaaagaaatttttttccattgatctgtgtctcttccaacacataaaattcaattttctcttttgtgtccggatctgtaaaaataactttttccatctttcttcctttcttatatttttctggtctgctgtcgtcatttggattactttctatggaccttatttttcttccggatgcattgcaagataatcaagatacccctgcaggataaaaacagccgcaatctcgtccacaaactttttgcggtcttccctgcggattcctgattccatcatatgcttatctgctgatacggtcgtcagcctctcatcccacagaatcacattaagtccggtacgacgctccagcatttctttgaattcttttgttttttcgcagcgctcaccctctgtattattcatgttcttaggataacccaaaacgatgcgctctacgttatattctttgataatttcctcaattcttgccagagactggcgcagtttattaggggactgtcttctgacgatctccagtccctgcgcagtaaataaaagctcatcgctgactgccacaccgacagtctttgagccgtagtctaaacctaatattctcattcaaaatctccatgcctctgcccttcatccggacagacttttcctgtaaggcatatattaatctgtacttatccgtttcttcttaagtacattaattccaatgattattcttaatatatgctttcaatacctcttctactaattcgtcacgctctactttcatgatcagacttcttgcattattatgactggtgatataagtaggatcacctgacataatatatccaacaatctgattcagtggattgtatcccttctcgctcagtgcacgatacacaattgcaagtacatcctttacctgcagttccggctccttctccactctgaaatattgcgtattattgatgttctgcatatttgtcacgcccttatactcttctttactctatggtaagaaagtaatccgtaattattcagtaccttcataattacagtaatcctctagcttattctaatatagtttgtcctaaaattcaaccataagatagatatcatctgtcaatctgccccggatcgttcctttcacaaactgattcgaaaggtcagctgccgacttcacagcgatctttacatactcttttgtgtatccggtaaaatatgtttcaccttcaaattcataagcctcttccatcagagctgtcacctgttttccgacatagtattcccggaattcttcagacattttcttctctaacgccagaaggatattgctccgctcttttttcaccggttccgggatctgatgttccatcacagctgcctttgttccttctctcttagaatactggaagatatgcatttcataaaaatggatacgttttaaatattcttttgtaaccgcaaattcttcctctgtctctcccggaaaacctacgatcacatctgtcgtgatggcaggatggtcaaaatattttctcagaatctgacatccctcttcatattcccttgtatcatatctgcggttcatgcgctgcagtgtggcatcgcatccgctctgtaaggaaagatggaaatgcggacagatctttggcagccctgcaagtgccgccgcaaatccatccgtcacgattctcggttctaagcttccaagccttatccgctcaatcccatcgacattatgcacttcccggatcagatggagcagatcgtcgccggtatctacaccgtaggaactcaagtggatccccgtgaggacgatctccctgaatccatgttccgcaaggcgtttcacttcccggatcacatcttcagaatttctgctccgcacccttcctcttgcaaaaggaatgatacagtagctgcagaactggttgcatccgtcctgcaccttgataaaagctctggtgtgctctgcggtgcgctctaagaacatttcctcatattcctgcttctcatgattgatatcgatcacattcccacactttccgtggtcattttcatatgcttcgagcatggaaagcaattcatgttttttgttatttccgatcacgatatccaccgtatcatcaagcagtgcctctgcctcttttgtctgcacataacatccggcgcctacaacgattgcatccgggttcatctttttcgccttatgcagcatctgtcttgacttgcggtctgccatattggtaacggaacaggtattgaccacatagacatccgcatattctgtgaatgggacaatctcataacctgcattttctaatatctgctgcattgcctctgtttcatatgcatttaccttgcatcctaaattgtgcagtgcggctttcttatttattttcattcgatactcctattttgtgttgacttttccataaaaaaccattactataaagttaactttgatagttaattaaggaggttttttatcatgaaaacagtacagatttctttaaactccattgacaaagtaaaatcttttgttaatgcaatcacccagttcgaatttgatttcgatttaatctccggaagatatgtgatcgatgcaaaatccattatgggtattttcagtttagatttatccaaaccaattgatttagcaattcatgctgaaagcaatatggatgaaatcatggaagtattaaaaccatatttagtttaatcatttccgaagatttgagccacagaagatatgttctgtggctttttctttttgcagcagacagttcctttttccgatactgcctgctttttttgttttatccctcaatgtggatcacttctaccgtatcaatggcttcctgcattaatgcatcaatcttttcgcttaactttctctcatcattatggatcacatttaagttcggttttgtcaccggatgttttgccacaaaaatggtacagcagtcttcgtatggaagaatggatgtctcatatgcatcgattttttcagagattgtgacgatctcctgcttgtcaaatccaatgagcggacgatagaccggcatcgtacatacctcattcgttgctgcaagggactgcatcgtctggcttgccacctgtccgatactctctccggtgataagaccgagacatttattctcttttgcaaaatgctctgcaagtttcatcatgtaacggcgcatgatgatcgtcaattcctcatgcggacactgctcgtagatataaagctggatatccgtaaagttcacaacgtgcagattgatcggtcctgaatattttgcaacaatttttgcaaggtcaacgactttttgttttgcacgctctgaagtatatggcggcgcatggaaataagtagcatcgatcgtaacaccgcgttttgcgatcatatatccagccaccggactgtcgatcccgccggataaaagcagcattgctttgccgttcgttccgaccggcattccacccggtcccggaataattgttgagtatacgttaatttttgcacggatctcaatattaaataccacctgtggatgatgcacatctacttttgtctccgggtaagcatctaaaatcttctcgcccatggctgcattgatctccatggactccatcggataattctttcttgcgcggcgggcatttactttaaatgtaaaatgtttgtccgggtacaccttatcaatgtatgcaatgacttcctctgcaagtttgtcaaatccttcgtcttccaacaatacaaccgggcagatcccgacgataccaaacacacattttaatgcttccacaacctcatcatattcatagtcgctcaacgtatcgacataaattcttccctgctctttccggacaagaaattctccttctgcctttttcaatgcatggttgatctggcttaccaatgcatcttcaaataaatatctgttttttcctttgatcgcgatctccgcatatttgatcaaaaatgatttatacatattttctcctttttcatgtcttttgttacttttccacaattcattttacactttcatgagtttcgcaattgccggactactttctcgtataacggcggagctttggcacaacctcgttcatgacttccagggcataatcgatctcttcctctgtggtatgcacggaaaagctgaaccggatcgtcgaatccagcagactgcccttaagtccgatgtttgtcaatgtatggctcacggatggtttgttcgaggaacatgcgcttcccgctgacacataaatctttctgtcctctaatgtgtgaagcataacctcactgcgcacgccgtcaatgctcacactgacgatctgtggtgcggaatcacgtcctgtctttccgttgacagacacaccttctatttttaaaacaccttccacaaaacgctgtttgatctgataaaggtggtctattttttcctcaaagttttcataaatctcttcggcagcctcacctaacgcagcaacgcccggtacgttctcggttccggagcgcatgcccttctgctgcccgccaccgtaaatcagcggttttaccttcgtcttatctttgatgaacagaaatcctgttcctttcggcgcatggattttatgtccgctgacagaaagcatatcaatccccagttttttcggaaaaatacggtactttccatatgcctggatcgcatccacatgtaccaatgtattcggatttttttcgttgatcaccttgattgcttcttcgattggttccactgctccgatctcattgttgaccatcatcatagagacaaggatcgtgtcctcacataccgcctcccgcagttcgtcgagtgaaatgataccatctgcatccactttcagatatgtcactcgaaagccaagttcctctaaatatcctgtaactgctgaaacagacgcatgctctattgatgtcgtgataatatgatttccggctcttttatttgccagtgctgctccgatcagtgcggtattgtttgattccgttcctccggatgtgaaaaggatttctttctcatccacctttaacgtctttgcgatctttttcttagcctctttgatatagttctctgcttccacacctttcatatgaagtgaggatggatttccgtaatcttccatcagaacttttaccatcaaatcttttgcacgttcactgcaacgggtcgttgcagaattatccaaataaacttctgtcaaatttgtttccataattatccttctttatctatgcagcatcactcttctactcatccctgccatcgatctgactctctaactgatatcccaaaatcgcaagggctgcaattcctgccgtctctgttctaaggatccgtctgccaagtgagatcagctgcatttcatctctgaccatttcaatctcttccggcgcaaatccgccctccggtccgataaacactgcgacactttcgcctttttctatctgttccattgcagccttcgtccctgacattccatgctcgttttcatagggaaccagtttcacatccagtcccttggcatatgccacagcttctttgtacgacatcggcatcttcacttccgggatcagacttctctttgactgttttgctgcactctctgcgatcgcctgccagcgcgtcacctttgattttgcctttttgtcatctaactttaccacacagtttttcatggcgaccggaatgacctcataaactccgagttccacggttttctgaatgatccattccatcttgtcattcttcgggagtccctgaaacagatagatcctgcatggcagttccgtgctttccgcctctttttccagaatatccgcacgcacaaagctttctgtaatatcagatatactacaaaaatagttttgtccatttctggtgcacacgcggattttctctcccggtttcatccgcagcacatttttaatatggttgacatcgctgccttcaattgtcacaaaatcttctgctgcattttcatcttctataaaaaactgatacatgtcttttcctaattctttcttgctgtaatgttcacccattcgccctgatgattgatctctacaacttccagaccggctttctcaattgcctctttcacgtcattctctttgaaatcgataattcctgatgtgataaaatatccacctttttttaaacgcgccgggatcaccggtgccattggaatgatcacgtctgccagaatgttggcaacaacgatatcaaattcttccgttccggttttttcctgaagttctgtatcatcgatcagatttccaacataaaatgttcccagtttctgatcgagatgatttacttccatattgtcgtgtgtggaagtcatgcagtccgggtcaaggtctgttccgactacctctgatgcccctaatttcagtgccacgatcgataaaataccgcttccgcagccaacatcaagaacctttggtgtctttacctgcggcgtatatgtttcatttccacgaatatatttcagcaactgccggatgcagagctgtgtcgtctcatgcttgcctgttccaaaagagacacccggatcgatctcgatcaaaaacttgtccctgtcttcttccttcagttcttcccatgttggtttgatcaggatatcgtcaatatagaaagagctgaaaaacttcttccagttgttgatccagtcaagatcctctgtctggtcggatgtgatctttccggttcccatatctaccacattccgcatctcctcgatggttgtctttacctgttttaacagttcagtgtcatcctgtccgttgtcttccagataaaaactgacatagctgatcccctcatccggtggaagttccggcagaaaatcaatgaacatctctgcctgatcttcttttgtcagcggcacattatcctcgatctgcacaccttcaatgccaagatccataagtgcagagcttaagtaatcttctgccgcagtcgttgtctcaatggtatatttattccatttcatattttatatatgctcctttttgcttattttccgttcagatcataaaaaaccattagatatactaccacaaagccattcaggttgcaaacaattccttttactgctgtttttttgcaagcttgtccaaaacttcatataagatctgcgcatcgatcggttttgcaatatgtccgttcattcccgcatttaaggctgcactgacatcctcctcaaaagaatttgcagtcatggcataaattgcgatcgttccggcatcttctctctctgacttccggattgtgcgtgccgcttcataaccattcatcaccggcatgtgtatatccataagaattgccatgtaagtacctggctttgccttctcaaacaactcgacggcttccttgccgttatgtgcacaatccacatccatatgtaccattgcaagcagttctgttgccacctcttcattaaatgcggtgtcttccgcaagcaatacttttttcccagtaaaatcatataccgcctgttcttcctgtaccacggacaaatcgttttccaccggccgctccgttatttccggttctgcagcctgttcgaattcaaatggaatagacacaacaaatgtcgttccctctccttttttcgatttcacggaaatggagcctgacatcagttccacgaaattttttgcaatggacagccccagtccgcttcctccgtgtttctgcgcagttgtcgcactctcctgctcgaacggctggaacagccgcgtctgcatctcctccgacatgccctccccggtatcttccacaaggaaattaaagtatgctttctcctccttcacatagagttccttcactttgatcgtgattttcccaccggacgacgtgaatttgtaagcattggaaaccagattcagcaaaatctggttcacacgaagtccatccccgatcagatatgtatgcgtcacctcttcgtcctgtacctcaaacactatccctttctgcctgcactgcggttcataaatcgtgcagacagacattaagatctcatgaagatcaaacggttcctttgcaattttcatctttttattctcgatagacgacatgtctaaaatatcattgataatatttaacagcaccttggacgacacatcgattttatcgagatagtcctctatcttcttcggatcatcctcatagtgttttgcgatctccgtcagtcctacgattgcattcatcggtgtccgtatctcgtggctcatccttgcaaggaaatcactctttgcctgatttgcccggtttgcctgatcgactgcttctaaaagctgttcattcttctccgcaatctttaaatagctttttcgtctcgcctcctgccagaaaatcataaacagaatactcgccaccagcaaaataaagatgacaataagcggatagcggaacttatacagcacatctgtccaggtaagctgatacccattctccactgtatggctgatcgtgatctgggatacttcctgagaggaaatctgcgtaatgcatttattgataatgctcatcagaattttattttcatcactgttttttccaacaatccccatcggttcttccttagacaggttaggcagtaccgtcaatccctcataccgcggtttctgcagcagcggtgtcaccacgttgacattctgtgccataaagtcgcactctccgctgttcagaagttccatacattcctctgtcgtagtgcattttacaatctcaaactccggataatttgcctggatataattttccagtgccgcataactcttcgtgattgcaagaatatacttattctctgcatctccaggtgtatagttcatcccctgcctgcagacaagcgccacttcccctgtatatatgacatctgataccagataatcagattttgtgaatgcaggattttcgactacgacaccagccaccagatctgccggatgtttttcaagataatctatcacacgctgaccactttccagcatcgtgtactgcagattcaggccactgctctcccggatccgactcacaagatcaacaatgatcccttcgatttctccgtcgtcattttccattgaaaacggcggtctgttattgataaacgccatattcacctgtttttgtgccctaatatattcaatttcttctcttgtaaatgcaagccccatggcagaagtatctccataatacttctggtacagttcacttaaaaatgtcggataatccgctgtgatctctccaagcgcataatcagcatcctccattaccttttgcttctgctttcctgccatcagataaaatggctgcgctccaaaccggcagataatcttataatcgtccatcccgacaagcgatccctgtacgactgcatccacagcaccttcctccaatgcctgaaaacattcttctgtcgtcatgtattctttcaactcaaacgaaaaatcattctttttggcatattctttcagatcatcattctgaaaactttccttcagtccagccacccggatgccgttaaaagcctcaaaatcattgtaataatacctgtcatcatccattcttgcataaagaacacaggcttctgttcccgcccagtacttcgaaagcaggaatctctcctcacgttccggtgttctctgcgcctgacagatcatatcaatctcacctgactccagttttttcagtatattgtcccatgtgtcatacacatattcgtacttccatccggtatactcagcgatcttatccagcaattccacgccatatcctgtatactccccattttcgtccagatcgataaaccctccataatcaatatatccaatacggattgtttcttgggaatcaatattttttccatataccacaaatggtattgcactgaaaaaagccatcacaaaaatgatgattccatgtctgatcttcttccattccttttgccccatcgttttctccctgtctgatgttccatcgtttttttcgtttccgtacctgtgtcttagatcctatatcgattatagcgaatttcacaccagaaataaagaaaaaggctgccgcacagcctttttctttcatgatcataatacttttgataaaaattcctgcaatctcggactctgtggatgttcaaagatctcctgcggtgtgttttcttcctgaatgacaccgtcattgataaacatgacacggtttgcaacctctcttgcaaatcccatttcatgtgttacaaccaccatggtcataccgtcctctgcaagttctttcataacgcttaaaacctcgccgaccatctcagggtccaatgccgaagtcggctcatcaaacaaaataatatccgggttcatggcaagcgaacggacaatggcaattctctgtttctgtccacccgaaagctggcttggataggcatccgccttatcagacagaccgattcttttcaaaagttccatcgcttttttctctgcctcttctctggtcattttgttgagttttaccggggcaagcataatgttttccttaatagtcatgtttggaaacagattaaactgctggaacaccattccgattttttcccgtacatggttaatatccaccgacttatccgtcatatccgtcccctcaaacagaacatgtccgctcgttgggatctccaacaggtttaaggatcgcagaaatgtcgattttccacagccggaaggtccgatcaatgcaaggacatccccttttctgatggtcgtggagattccttttaatacttcatgatccccaaaagatttgcagagatcctggatctctaagatcacctctgcagaattggttgtatttgtattatcgctcattgtttctcaacttcctttctaagacaccgacagctttgctaagtccgactaccatcagaagataaatgacagcaactgcgatcaacggcataaatgcctcatatgtaacgcttcggataatgtctccaccttttgtcagatccatcagaccgatgtaaccactgatggacgtctctttcaataaactgataaattcgttacacagtgcagggagaatattctttactgcctgtggcaggatgatggtggtcatcgtctgtctgtaattaaggcctaagcttcgtcctgcctcgaactgtccgatatccactgccataattccggaacgcacgatctctgccacataagcagctgagttcaaaccaaatgcgatcactgctaccacgatttttcccgtgttaatactctggaaaataacataatagataatcaatagctggatcatgaccggtgtaccgcggatgatcgtcaaatatgctttacagactgcattcagaatgccaagcccgccatttctgtcatggctggttctgacaatggcaattaaaaatcctaagacaataccgatcatcaccgcaaaaattgtaatgatcaatgtatttccaagaccttttaacatatatgcatagcggttatcctgaataaagttctggtaaaatttttcgccaaacgaactctttgctgtcactgcattcccatcacgtacaatgatcacctgcttggaagttgcatatgtatctgtaaagttgacattcttctttcgttcttctgtcacggtaaatcctgcagcgcccacatctatctttcccgtagacacagccgggataatagaatcaaatgccatatcttcaatcttcaattccataccgagcttatctgcgatcgcctgcatgatatccacatctataccgacgatttcattattctcataatactcatatggcgggaactcagcatttgttcccatcgtcagtgttccattcccccgggacacatcctgtggttcgtatggataatttcctttttctgcatctgttcctatataattttttgtaatccggtcaagcgttccctcgcttcttaactcttctaatgccgtattaaccttttccagcagatcatcgtttccctttgcgataacgatcgcatattcttccagcgtaaattcttcatcgagaattttaagtcccggattctcctccacaaatgcgagcgccggctgttcatcgatcacaacacagtcaatctttccctgttttaatgcctgaactgcatctgcgcctttgttgtaacgctccaccgttgttcctgatccgtcattttcataatcggaaacataaatatcaccggttgttccaagctggacaccaatcttttttccaacgatatcatccacactgctgatcgcaccggctgtttccgtggatgctgcttcctgatcatccttctgctttgtgccgcatccagcaattcctgtcagcacaaatgtcagaacgaaaagccaaagcagcagttttttactttttttcttcatcataaatatccgctcctctttttttctgattgtctgcataaatatacattatttttcattgaaatacaagtattttggactcaattgttaagattccctttccgatttatcagggaactgatttttttcttatattattatgtaacattgtggcttttttccttgactgtcccgcaaaattacattaaagtttgttttagaaaacacaaaggagattttatctatggaaaaaattgcaagctttacaatagaccatatcaaattagaacccggcgtttatgtatcccgcaaagataccgtcggtgcagaagtgatcaccacatttgatctgcgcatgacttccccaaacgatgagcctgtcatgaataccgccgagatgcatacgatcgaacaccttgcagcaacatttttaagaaaccatgctgtttacggttccaaaactatttattttggtccgatgggatgccgcaccggattttatctgcttctcgcaggtgattatgaatcaaaggacattgttggtctgatgatcgaaatgtttgagtttatccgcgattttaagggcgatgttcctggcgcaagtccaaaagactgtggcaattatctggatatgaaccttggtatggcaaattatcttgccaaccgctatcttgaaaacacgctctatcatattgatgaaaaacatctggtgtatccggaatagagttttcaaaacagacattgtattttctattgtcataataacaaacccggtgtaatctctcagcagagatcttacaccgggtttctattatctgttcattttactaaaatgatccatttaatctttagaatctgttttagatatcatcaaaagattcttttaatttatccatgaatccctttttcttcttacccttttcctgggcgccgttaccaccggcgttgcttcggtttaaggacgcacctgtcagttcatcaaaatgacgtaacgcctctttcgcctcattattaagacctgtcggtgtctggacaaccagagttacatactggtcaccacgaacccctttatttctcagggatggaactccctttcctttcagacggatcttggtgtcggtctgtgtacctggttttacttcgtaaagcacatctccgtcaacggtattgatacggatctcaccgcccaatgcagcctgcgcaaacgtaaccggagctgtggaataaatattcatatcctgacgctggaagattggatgtctggatacaactacttctactaataaatctcctcttggaccaccattgacacccggctctcctttttcacggatacggacactctgtccattgtcgataccggccgggatcgtcacctggatttttctctttcttgcgatatatccggtaccacggcaatccggacatttgtctttgactaccttaccggtaccattacaatccggacaagtctggacattctgcaccgttccaaagaaggactgctgtgtaaacacaactttacctttaccgccgcacttggtacatgtttccgggcttgttcccggttttgcacctgtaccatggcaggttgcacactcatccttcagaaccatttcaatttctttctcacatccaaaaacagcctcttcaaatgtgatccttacactggtacggagattcgcacctttcatcggtccatcattgcctcttcttctggcgccaccgccaccgaagaagtcgccgaaaatatctccaaagatatctcccatatccatgcctgaaaaatcaaatccgccagcaccgccgcctgtgccatcgaatgctgcatgaccgaactgatcatactgtttacgcttttctgcatcactcaatactgcataagcttcctgtgcttccttgaacttttcttcacattctttatcacccggatgcatatccggatggtacttcttggcaagagtacggaatgccttttttatatcagcgtcactcgcattcttcggaacgccaaggacttcataataatctcttttctctgccataacgcttaactccttgttatcatgtacaaatttatcataccggctatctgtctaaagcatgattcaatttccggttttcaaaaatcttcaaatattttcctcttctaccgcatatagggtttccggaaaaccggaaacccttttttatatgctgattatattttagacctctttgaaatcagcgtctacaacatcatcatctgctgcgccggcattgtttgtctgtgcgccgcccatgtttcccatatcaggacctgctccctgagcaccctgtgctgcctgtgtctgctcatacatcttagcaaatactttctgtgcactctgtgtcagtttctcctgagctgcttttaattcagcaacatctgcgtctgtcatctcttctgcattctgatgtgcgtccaggaaagattttactgcatttaagtcagcttctacttcagctttatcatttgcatcaaggtttgctccaacctgatccaatgcctgctgtgtctggaatacgaaggaatctgcatcgtttcttgcatcgattgcttcttttctcttcttatcctgtgcttcgaactcagctgcttcttttacagccttatcaatctcatcatcggacatgttagatccggatgtgattgtaatgtgctgctcttttcctgttcctaaatcttttgcagaaacgtttacaataccgttggcatcgatatcaaatgtaacctcgatctgtggaacaccacgacgtgctggtgggataccatccagacggaactgtccaagggatttgttatctcttgcgaactgtctctcaccctgtacaacgttgatatcaacggctgtctggttatctgctgctgtagagaagatctggctcttcttggtagggatcgttgtatttctctcgatcagtcttgtagcgataccacccattgtctcgatggataatgataatggtgttacatcaagaagtaaaatttcaccggcaccggcatctcctgctaatttaccaccctggatagaagcaccgattgctacacactcatccgggtttaaggatttgcttggctctttgcctgtcaactgtcttactttgtcctgtacagccgggatacgtgtagaaccaccaactaataatacctgaccaagatcagcgtttgtaagtcctgcatctttcatggcattctgaaccgggattgcagttctctcaactaagtcatgtgttaattcatcaaattttgctcttgtaaggttcatatcaaaatgttttggaccttctgctgtagctgtgatgaatggtaagttgatatttgtagttgtagcagaagataactctttcttagctttctctgctgcttcttttaatctctgaagtgccatcttatctgtagataaatcaacaccctctgctttcttgaattcatcgatcatccactgtgtgatcttgttatcaaaatcatcaccaccaaggtgtgtatcaccatttgtagctaatacttcaataactccgtcaccgatctcgataatggaaacatcaaatgtaccaccacctaaatcgtataccatgatcttctgttctttctcattgtcaagaccataagctaaagctgctgctgttggctcgttgatgatacgttttacatcaagtcctgcaatcttgccggcatcttttgttgcctgacgctgtgcatcattgaagtatgcaggtactgtgataacagcttctgaaactttctctcctaaatatccctctgcatctgcttttaatttctgaaggatcattgcggagatctgctgtggagaatactgtttatcatcaattgctactttgtaatcagatcccatatgtctcttaatggaagagattgttttctctgcgtttgtaacagcctgacgttttgcaggttcaccgactaatctctctcctgtttttgtaaatgctacgatagatggtgttgttcttgcaccttcctgatttgcgataacggtaggttttccaccttccataactgctacacagctgtttgttgttcctaagtcaataccaataattttactcataataatttcctcctttaattagctacctttaccatgctgtgtcttaccacagcgtctctgtacatataacctttctgaagttcttccgctactatattttcgccaagctcttcatcttccacatgcatgactgcattatggaaatttggatcaaattcctgtccaactgcctcgattggttttacaccaacctcctctaatgttgtaaggaattgtttgtaaatcttatccataccaacgacaaatgcatcttcctttttgtcttccggtacagccgcaagtccgcgctcgaaattatcgatcaccggaagcactttctcaacaattgtttttgctcccatatcaaacatctgtgatttttctttctcagtacgtttgcggaaattctcaaattctgccatctggcgtctcagacgatcggtaagatcttcaatctgttcatctttcttatcttttttcttcttgaagaatccctttttattgtcatcagaatcctctttggaagatccttctgtctcttccgccgtttcctctgtgtctttctcttctgtctcagaagctgtatcctcagtcgtttcagcttcttttacggaatcttctgtctgatctgcctgggactctttttctaaatcctctaaaacctcttctaatacttcttctttcttcgcttcctgcatttcccagccacctttctatacttctccttttggcttatctaagatgccatccagagattttttcaatgtgttcagattcgccattactttctcataatccatccgcttcggtccgacaattcctatcgttccccgaacaccttcgcccaattcataagttgcagtcacaacactgcagtccttcatcgtctggatcgggctttcattccctatataaacctgaattcctgtattctcttcatccaacaggttttcagttacaaggcttgccaactgctgtttctcctcaaatgtggagatcagttcacttgctttctccgctgaatcagataactccggatatttgaaaagatttgtcgtaccactcgtataaatcttaatatcctcatcctgacccattgtctcaccaagtgtatcaagcacgttgctgacgatatcactgtggatacctgcctgccctttcagcttggcgatggtcgcaagattgatctcttctaatgccagaccattcagattcgaattcagcaggatattcaacttcaacattgtctcattatcaagcggttctgataccggaatgatcttattcttgaccatgttgccctctgtgacgatcactgcaagaatctgttcctcatccacattagagagctgaatgaacttcactttgttccgatgataactcggcgctgataccattgttgcatagttggtattggctgccagaacttttgcaaccttctgcagtacctgttccatcttctcggtgtgttcgatgacaaactgtttcatgtcatccacttcccggttcttctcttccatcagatgatctacatagaagcggtaacctttatcggaaggaatccgtccagccgaagtatgcggctgtaaaatgtatcctaactcctcaaggtctgccatctcattccggatcgttgctgaacttaaattcaggtctgtatactttgaaatggttcttgaaccaaccggttcacctgtttccagatagttgcggatgatagcatttaaaattttcgttttacgttcgtctaattctaattcttccattcactcactcctgcttctggaaatatcataattgtccaacaacgcttgtcactgaacaattatctgtgtgtttttagatttgttagcactcatttgattggagtgctaatatctatgtacctaacatagcaccatcctatttttttgtcaacagtatttctgatgttttttgaagattttttgtgaaaaaattgtgtcctgccagagtttagcggtcgtagtgtcgcagattttatggtgctttcttaggttttgaagtgcatatataaatgtccgttcacaaggcaattttatatgtaatgaaaaagaaaaacgtaggattgtaagtgtgattgtggtagaattatgtttagtaatgaatttataaaatcagaacttgtaaaggagatatacaacatgaagaaagtctgcttagcggttttgccagctttaacaatagtgttagaattattacccttgggagcagtttgtatttttgcaacatctccaacagaaagagtaaaagaaacattctcatactttagccttacaccgtttggctatgcaaattttgctccacttattacagccacacttactgttgccatcttcttactttcattgttttcattgaagaagaaaggtgttctcaaagcattgtttgtcctttccattattacggtagttatttctcttttgccattgatgtatggcttaaactactatacccttgtaggagcctttataacagtaacacttgtaatagaaagtattttggctaagatacaacaaaagtaaagcgataacttccagtttaacaaaagtgaggaactaatgcccgaatgggcattagccattatacaatatccattcttatttcatcaataatacttttatctcttaacttatgaatttcagttcgtgtgatagaaaacacaattcctatcaaaacaaatataccaccaaataatgccgcccacggaaaatgatacaataccgggaaagccttccgaatggataaattaattaaaaatggaattgcaattccaagtatcactcccggaacaagtgcatttagaacgcaaaaaatactttcactatataacatcctgcaaagtgatttatttgtcattccaacactctttaacactgcaaactcacggcttctgattctgatatttgtcgtcagcgtactaattacacttgtaaatcccatgagaatgagcaggataacaaagccatacatcacaatttcagcaagaactatagctatattgagcattttaatcatagcatctgtgcgggcaattctcacggtatatccctgctctacataagaatcctctgccacaatcggaaaatattcatccataacacttctggcatactctgtataatcatcttcatctgatggcatactaaaccagtcaaaactcctcgcatccgcatcaggtacgactattctgactggatatggtgtcatttccccaaaaccatattcctttaaatcggactgttctaaaatacctccaattgtaagtgtgttcttctcattggctgcgtttatcagggaaatctgtgtcacatcatctttaaaaggttttatcgacacatactctccattgtcattatattggtaagtgttcagcagaaggatacttccatattctgcgcctgccctgtcacacagttttttatagagttcatcatcaacggacacgatttctgtccttgtttccccactatcatcagaaaatttcggaacctgcagcatatcctctgttaatgtatttatatctaatagcgcattgtaggtaaaagtatctgctccaacaccatatacgtctatcccgtacttttccagcttttgtgtgatttcattatattggtctgatgtaacaggtcggctgatttttctctcttctttccctgttttcgcatttacccaggtatcgtaattggaagaataatccaccatcatttcttttgattttggtgtcatccattcctggaattcctttgcctgaccggataatcctccggttaacagaaaaagtaaaattccaagtgacaatgcacgtatcgttgccttatagccgtatttgtttcttttcatgtttttataggcaattgcagactcacatccaaatattttttggataaagctgtcttttacctggatctctttcaaagctgtacctgctccaatcccttttacacactggatagcagtaaatttaccaacctttttagctggtctgtatgcagagaataacacaatacaaaacgaaaatacacctgcaaacaaatatgtccacacagatatatgaaagggcagggaaaaggtaaaaggtctcataataatttcttttgcagcatcattgatatcggaaataaaatgtcctgtaaatttcacactcatataaccaagtatcgttcctgcaatgagtccaagcgggatggctgtcagactaagccataaactctcatagataacacttgcccttatctgcctgcctgttgcaccaacacattttaaaataccaaactcctgaatccgcttattggcactggcagaaaatatattggatattacagtaatcgacattgccgcaataagaagacctaaaagcagtgccggtattgcaagcatgagagagtatgctcctccatattctccataatccgaaccaaggaaatcagtaagcatcttatttgcacttgtcacaaagcacattacagttgtaataagtgatgttgcaagtgcgatcgcaaaaattcctgcaatcgttctttttttattcactttcatctggcttaaggcgagttgtgctgttattttcattacttcatcacctcgtcttttatgatttttccatctccgatcgtgatgatccggttcgccttcagtgctattttttcgtcatgtgtgacaagaagaatcgtctgcttatatttctgattggtgaacttcaaaatatccagaatctctctgcttgttttactgtcaagatttcccgtcggctcatctgcaagaataaatgccggctcgtttataagtgcccttcctatggatactctttgctgctgacctcctgacatttgacctggaagatgttttgcccttttctcaagacccagcatattcacaatctcagaaagccgttccttattctcttttcttccatctaatttccatggcagcgcaatattttcctccgcagtaagagtggggatcagattataaaactgataaacaattcccagatttcttctgcggaaaattgcaagttcatcctcactcattgcttgtatttcatttccatcaatgataatagaaccgcttgtcggataatcaattccgccaatcatattcataagtgtcgatttcccggaaccggatgctccgatgattgcaacaaattctcctctttctaccgaaaaagacacatgatcaagcgcaatcacttccgattcgccttcaccatatttctttgttaattccttcacttctaaaacagccattgcatttctccttgttttaaataccatcttatagacaattgcgaaactcctcataatcttctttaaattgttcaaaattaacaaaaacattcaagacacgctctcgctacgtgtcgctcgcagcggtactaagaagcctgacacaacctagcgttgtatcagtcttctaagtgccggcggctccccagtgtctttcatgtcttttgtcaatttctcacaattcaatttaggttttaataagtttcgcaaaagcctaaataccatcctagcaatgcaaaatgactgtaccgtgacaaaagaaattattattgtgacaattttgtcacttagaaacaattccgggtcttccagcataagtgatattacttgaaaaattttaaaataaaagtcgttccctctcccctgcctccaaaatcaacatcaatgtcgccaccctgccctttcagaatagagagtgcaagcggcatcccgattccaaatccattttcattggtagaattttcaaaccttttaaaaagagcagcatactctgttttgtccattcccataccgctgtccctgaccgaaatccagctatacatgggattttctccgctgtcaatctcaatcacacttccatccggtgaatattcgatcgcatttttgacaatgtttgtgagtgcttctgtggtccagcgtttatcacaatgtatgatgcaatcctgtttcagctctatggtcagactgtggatatccaaaaggattgccaccgatggttttaccgcctctaagagttctgacgtgtggatgtcatttttgataaaatcaattgcatgggcatcaagctttgccatcttaagaagtgcccctacaagccactccattttatttaacaaaatctgtatgttatgaatgaactctgtctgtttttccggctctgcctcctccaataaatccgccataatcatcatggaagtaatcggtgtttttaactgatgggaaatatctgccatatagtcagagagactgtctcgttctgtctcaactgcctttatctgttcatttttcgtgttcacaagagcataaatatcattttttaatatgttaaaagagccttccttattcactcgaatatccagttcctcgccggaactatagcctttcacaaactccgacaactgttctatctcttttttcttaatccacacgatatcccattcctctcacagtctcaatgtgtattgcctctccaagtttctcccgcagccgtttcacataaacggtaagtgtattatcctcaacaaaattgccgtctgcgtcccatattttgtcaagaatctgctgccttgtcaaaagtaagcctttattactcgcaaaaataagcaacaaccgatattccaatgctgtaagttctatgattttatcattcacataaacttttgcctcatctgtatggatggctgcatgacccatatagattatgttgtccttctctccatttttgatattggcagataaaatgcgccggactctcgccaaaagttctctgattctgaaaggctttacaatataatcctgtgctccttcatcaaatgccctcacaattgtattttcatcatccacaactgtcaggaaaatcacagatgtagcagtattttggaatatctcacttacatcaaatcctgttccatccgggagctgcatatctataattgccaggtcaaaattataatgttctattaaacttccggcatcttttatacctgtggcatgatttgtttcataaccttctgtctcaagtgcatacagaatccccgaagcaatcattgtgtcatcttccaacaaaagtattctactcatgaattatttctccatattcattcagcaataaatctaattgttcaaattgggtcatattgtgttctccttcttgctaatataataattcatattattgtgaaagtaaattgattacttgggaaggattgcctttacataacacccactttcgaaaaatgaattttttgttgtttttgaaagcggcatcttgcatatactatttatagacagtataataaaaatatcaaagcagtttcaagaaatgaatttttttcaacttttgaaagcgtgtgactatatgaaaacaatcacaagaacaaaatatctcgacagaatcattgagctgaacggtactcccgacatcaagattatcacaggtatttgtcgatctggcaaatccaagctgatgcaggcatatattgagtacctgaaaagccattttgaaaatatcaatatcatcttcattgacttcatggatttgacgtatgaagaaatcagggaataccatgccttacacgcctatgtggaagaacattatcaggcaggaaaaacaaactatctgtttgtagatgaggttcagatgtgtcccaagtttgagttagcaatcaatagcctgtattctaaaggaaaatacgacatttatgtaaccggctccaacgcatttctgttgagtgcggatttggcaacgttgtttaccggacgatatattgaaattcatgtgtttcctttcagcttccaggagtattgccaatattacgatgatgtcagtgataaagataaactctttgatgattactccatcaaaggcggtttagcaggttcctatgcttatagaactgaaaaagacagaacaaactatataaaggaagtctacgaaaccattgttacaagggacttagtacagaaatatgctctgccggacactttggttttgcagcgtctgagcgagttcttgatggacaatatcagcaatctgacttcgcctaataaggtcagtcagctgctgacagcaaatgagagcccaaccaatcatgtgaccgtaggcaggtacatcaagtatttgtgtaatgcctttgtgttttatgatattaagagatacgatattcgtggcaggaaatatctcgaaagttctgagaaattttatctgtgtgacagcggtattcgatacgcaattctgggaagcagaaatatggactatggcagagtttatgagaatatcgtttgcatcgaacttcttcgacgtggatacgatgtctatgtcggcaaactctataaaaaggaaattgactttgttgctcagaggggcagcgaaaaaatttatattcaagtaagtgataacatttccgggcaggagacatttgagagagaatgttcccctctgcttcagatccgagatgcctatccgaaaatgatcattgccagaaccaggcatccgaaatatagctatgaaggaattgaagttcacgatatagctgattggctgttacaggagtaaaaaagcctatgatatgggatattctattaatactaatcagcacacgccatttgcaagtattgaaaatgaaaaactaatcgttgaaatttgcgattcactgtccataggtgcagcaattgaaaatatgattctgacagcaacgggatatggattgggcaccttatggattgccaatacttgttttgcctataatgagctgatggattttatcggaacagacagccagttgacaggaattgttgcggttggctttgccgatgaatctcctgctaaaagaccaagaaagcccttagaagaaatcgttgagtacagataggtaaaaccggagtttaacgtatgaactgccgcctgtaggtggtgttacggattttcgcaggttatgttaattgcatgccaacaaagtgtatagaaatctaaaaaatagaactgtttgttttcaggagcgcttccgcttgttgtcgctggcagcggtactaagaaagcatccatcgtgatttcaaaatccaattgacattgtcttttgaaatcgcaatgtctgctttctaagaaccggccgctcccaaaatcctgaaaacaaatcagttctattttttattgagccaagactgtgcagcatgcaatatcccagttgtgaaaatccgttaatccatattgcaagcggcagaacccaaagatgaaactctgggaagtgtgccctttatcatcgacgaatcacaagacattgaaaacgactgcattttgtcgttacctcctttataggcactcatcccataaccgtgagttccataacgtaaattggcagattctgtggtgcgattcacagtgttgattgggcatgtataagcgtcctctcacaagtcattcgtaacgtaaatgaaagaaaaacgatataaacaaatattattttctttgtgagctatggagataggattctaacaatcttgggaagcactgcttctcaagattgttgctcagaagcctatcggaatgcccagcgaacagaaacataatatttcgtttataccgtttttctttttcattacatataaaattctgacttgtgaaaggacgcttatatctgccccttcacaacctataaatgcaccgcagaatctgcgacactacgctagttaaactccgggttattcatatctcaatgcatcaatgacttccatcttggctgccttgtttgcaggatagtatccgaagaatactcctgtcagcatggagaagaataaggaaagtacaatagcggataaggatggccgtaccgacataataatgtagcttgaatattcagaatacatattctggatcacaaactccgctgctttgcctaatacaaatccattaaacaccccgatcaatatcccgatcattccaccaaagatacagagtacgatcgcttctatgacaaactgcatacggatggtactcctcttcgctccaagtgccatccggacaccgatctcccttgtacgctcggtaatagacacaagcatgatgttcatgacaccgacaccgcctacgatcaatgagatcaatgcaatgccggacactgcgatcgtgatcacattaatgacggtattgatcattcccatatcagacgccatattataggtagtaacatggaaattttcattgtttgcatatttctcttcaaaaaagtttgtaacatctgtcgttgcctgatcgatatcagccagggaattgaccatcaggttaaagtttgtgtaaccggactgatcctttcccatcagcttaaaacaggtctggattggaataaacattgtagtataacggtctttttccgggacgctggtgtccaccttgccaaaaagtgctgcattatattcgtatatgcctacaattgtaaaattatatagatttccatcgctgtctgcataagtgatctgttctcctattggattctcatctccaaaatactgctttgccatggtatcagccacaatgcagacgttcttctttgttttgttatcctgttttgtaaggtttcttccggcatacatctttaatttcatataatcaatatactcggaagtagtcccctgaacggatacattggcataagtatttttatcctgccggatctgtccgtttccaagaaattcagaagctgctattccatcaaattcatccggatatttttccaccagttcatcgatcatctcctgtgtcacaaagtccgatgttttcatttccgggtattcccaggtatcccagtccgcatcatcttccggatatcttgcatccacatatgcctgaaccgtattgccacccagtgaatttaaagtggatgtcaaagtagtctgaatggaattaccgatcgtcgtgatcgtgatgactgcactgataccgatgataattcctaacatggtcagaaccgaacgcattttattgctgaaaatgctggtgatcgcctcttttatattttccaaaaacatcagccttcacctccattatctgacacgatattaccatctaagatcgtaacaatccgttttgtctccgccgcaagttcctgtgagtgtgtaatcaaaacgatggtttttccctgctcctcatgcagcttatgaaaaagatccatgaccatatgtccggttttggaatccaacgctccggtcggctcatccgctaagatgatcgccggatcattgatcattgcgcgcgcgatcgccacacgctgtttctgtccaccggaaagctcgtttggtttatggaaagcacgttcctccatgccaaccatttttaacatttccatggctcgctctttttgatttttttccctctcagtactatataacagcggaaccatgacattttttaatgcattggctttcggaagaaggttaaaattctggaatacaaaaccaatcctcttgtttcggattgcacttcgcatggaatcatccattttatttacatcttttccctccagaaagtaagttccctcagtctgacggtccaggacaccgataatattcatcaatgtactttttccggaaccggactcaccgacgatggagacaaattctccctgatcgactgacaggctgatcccatttaaaatctgcagttcattcggcttgcctatgtaataacgttttataatattctccatacggattactggttcactcacgatcattctgcctccgtactcatcatgccttctgtgtcaagtgcctgattggaatatatctgttccggagtaaacacctgaccttcggtgacagaaaatgtattatcgtagatcagctggtcgccctctttcagatcgccgcctgtcacttctgtatagtaatctacctcttcaccgactttaatatttttccggactgcggttgctgttccatcttcatttgcttccgctaccagaacataggaatctccgttgtcatcctgccggatcagatcatatggaactgcaagctgtgtacctctgtctttgatcacaattttggcttttgcactcattccaaccagaagttctgtgttgtcgatcgtgatctcagcagaataaccgcttgaggtattggtatctgtaccgtttgtgttggttgactgattttttactctgaccacacgtgttaccgtacctttgatctcttcatcccccgttgcatccgttgaaacggttgcaggcattccttcctggatctttaaaatgtcagcttcctcaacatttacgatcacttttaaggaagatgtatcctcgatcgtgatcatggtcgttcctgctgtgtttttatctccgactgatacattgacggctgtgacaactccaccgatcggtgcagaaagtgtacagtctgcaagctgcttctgtaactgttccagctggtcttttgactctgtggtcgtgcttgcctggtatttttgcatatcaacggtattctgggcagatgcaacgcttctgtccgtgttttttaacacagatgcataattgtcatttgcggaatccaatgcattttgtgctgtctccaaagatgatttaaaaacatctaattttccatcatactcagaagtatctttgtggttgtttttcagataataaatataatcctcacactctgatacctttttcttatatttatcaacatcagcctgtgctttatcgatcgtcttctgtgctgcatccagtgcatcctgctgatcctgtttgttctgggtaagactgttctgcttctgtgcctcatcgtttgctgcaacagcattcgcattattaatatttgtcttcaactctgcaatctgtttttcaatatccttctgatccaatgtcacaagcggatcaccctcttttacaatgtcacccacctgaacgttcacggctgtgatctctgctgctgcaagggacatgacatttgtcttgctctgccctgcgatcgttcccttcaaagaaaccgaatcggataaatcccttttctctaccggttctatctcaaccatattcgctgctgtctcaatctgtgaagtcatatttttaacagtgctgccgatcaatacaattacaatagctgcaatcactaaaacgatcagccatactttcttctttttctttggtacttcagccacttctgcctttttttcttttttatgaaagaaatgctttttttcctttacattgttgtcttccatgcttacataatctcctttttttccttgtcttttttgacttatggcaaattgtaccatatttttttcagaaaaaaaggggattaatgtaatcttaatatttctttcacgtttctttatgaaaaggaatgatttctaaaaaggtctaaaaaattatctggcatttttcgttccttttgctgctaactaacacaagtcccgccaacagcaaaagcgggaaaagaatcgaagctccaattcccacgcgcagattattggaaaacgcactcgaaacaaatcccacgagtgtcggtccaccggaacagccgaggtctcctgccagcgcaagcagtgcaaaaagcactgtaccaccccgctttaaggatgcggacgctttgctaaacgttcccggccacataattccaactgaaaagccgcagattgcgcagccccacaagttctaccgccggaaccggcacaaatgcgatcagcagataagagccaatgcaaagcagcgtacttaatttcataaactgatccagatcgaatctgtctccatattttccataaatcaagcgggaagttcccattaaaatagagaatgccatcggtcccaccagatcaccgatcgttttggtgattccaagtccctgctccgcaaacgctgatgcccactggctcaccgcctgctcggatgcaccggagcacaccatcatgatcattaaaaaccagaatactttttcccggaaaagttctcccatggtcatgcccttctcgccctcttcatgcagactgtagattggcacttttgtgaataaaatcatattgcagaccggaatgatcacccacaacagtgtgaggattttccagtgttccgttccaaacagtgcgaaaaacaccgtggaaaataaaacaacaccggtacatccccaacagtaaaaggaatgtaaaagactcatagccgcttccttattatccgtcgggcatgcctcaatgatcggactgaccagcacctccagcaatccaccgcccactgcataaatcatgaccgacattaaaatgccaacaaacggatctgcaaaaagttccggcaaaaccgtgagcagtaccagccctgccgccgcacagatgtgggcgatgaccacggatgcccggtaaccgattttgtcaatgaaccctgccgaaagcagatcgatcagaagctgtatcacaaaattgattgtgataagcagtgtgatcttcgtcagcggaatctggtatgttttctggaatgtcacgaacaacagcggaacaaagctgttgacgatcgcctggacaatataaccgataaagcaggcgtatgttgtttttttatagtcttgtttcattttcatcctcgctttttatatgtgttttcagccaaagcctccttcttttatagcacataaatttcttttttaaaagcaaaaatcaccttccatgacattgcgcacggtaagtgtcatgaaaagtgattttatcacgcattttttaataaacgtttctaattttttactctatttttcatataagaattcttccggcagtgtcacattgaaatcttttgcaagaccacggaaattatccggcgtgatggtctgtctcttattcggctgcattgataacattttcacaaggatctctgcggatttctctgcggtgtgcattaacccaaatgtcaggtcaaaatcttctcccgaagcaaacattccgtgatgtgcccagattgcaagattgtatttcttcattaattcactggttgctactgcgatgtcacggccgcccggaaccatccacggaacgacacccacaccttctggaaatacaaccggacattctgtcgccatctcccataattctcttgtaaacactttatcttccaatggaagaacaaacgtaagcgcaataatattggttgtatgcgcatgatagatgactctgtgttttccaccggttgcgatcattttcacctcatgattcattaaatgggacggaagttcagaagttggtcttccaccattcaccagcccccaaacgatacggtaattttcccctttttcatcaagttcgatgatacagatggaatcttccggtttgatgatcacattacggaaatactttccacttcctgttacaagaaaatactcttttgcaagttttggaacgcttgttccaattggctgccactcttttggctcaaaatcttcctttacggcttccacttcttccggccggatacgataggaaagatttccgccatttctctcatgccatccctgctcccatccatcatttgccatgcggataaatccctgcacaaattctgcatctaatactttcatgttttctttcctccatttaggttttctatcgtcatttttgcgtcagaacgaactgccttatttttcacatagcctgctctggctatcgatttaacagtacttctttctcatatctctctacttctgcaaaccagttcttatctgcgggaactccacattcctcacagtatttggtccatacatctccaaatggaaatgtctttaattcttcctgcatgaccataagctcggtcagacggttctcatcctgtaattttttcagttccgcattcggtgtgcagagcgcagataatagtgctttctgccagcttctgaatcccaccgtccatgcactgatgcggttgatacctgcatcaaaataatcaagtgccatatgtactctgtcgatcgcatcacatcttacgatctcttttgccatctcttttgtctcatcatcaaataagacgacatggtcagaatcccatcttaccggtcttgtgatgtgaagtgcaatctccgggaaataacagagtaaagccggtattttatccgatactacttctgtaggatgataatgtccgttgtccatcagcggaaggacattctcgtgtgtcgccgcaaatgtcaatgtaaactcggctgatcccgctgtgtaagactccacaccgattccgaataccttagactccacacatggttttaccagctttggatcatgtggttctgcaatgatctgttcaatggaatccttatatctcatgcgtggtcccatgcggtctgccggaatatctttgtatccatccccgatccagatattcatcacacatggaacacctgtctcttttgcaaaatattccgaaatgcggatacatgcttttccatgctcgatccagaactttcttgtctcctcgtccgggcttgtcagtgtcagtccgtcttttactttgtcatgtgaaaaaaatgtcggattaaaatcaatcccaacatggtgtttccttgcaaagtctacccattttctgaaatgctttggctctaatttgtcgcggtctgcaaattcgcctttctcaaagattgcatagcttgcatgaagatttaatttctttttgccaggcatgaggctcatcgcctcttccatgtcctgcatcagctgttccggtgtctttgcctttccgggatagtttccggttgtctggattccgccggtcaaaggtccgtcatggtcaaatcctgtcacgtcatcgccctgccagcaatgaagtgataccgggatttcttttaattttgcgatcgctgcatctgtatcaacaccgacatctgcatacattttcctggccgcttcatatctttcctgtaccgtcataaaatttttacctcacctttctgccgggcacaacatccgcttccggcatatattttttctgatattcctgattgctatttctcatatttttttatttcaaaagactcaaagatacattttcttgcagcctgtaaattttcaagttctcctgctgcaataatctgcgccgtcagatttccgatggctgttgcctctgtcggaccggcataaacggtctttccggttgcctttgcagtcagttcattcaaatacgccgcattggctcctccgccgacaacatggatgctttcatatgtaatttctgacatctcctcgatctcccggatcgtctgtgcgtagcattgtgcaagactgttataaatcacgcacgctgtttctgcgattccctccggtatccgctgtccggtctctgcgcaggctttttgcacttcttctgtcatgctttgcggtgctaaaaaacggtcgtcattacagtctaccaaagatgcaatgtccgcccttgccgccgcctcgcagatctctccgaatccctgctttggtgacagttcttttcggaccgactgtatcatccagagtcccatgatatttttcagataacggaaacgatattcatatcctccctcgttcgtgaaattatgaagtctgctttccggtgaacagtctgctttttttaattctgtccccatcagtgaccacgttccggaactgatgtaaatggtattgtcctcatttgtcggaactgccatcactgcggaaccggtgtcatgtgttgccggtaagacgacttcacaatcaaatccgacctctttctgaatttctttcgtcagatttcccagtacggttcccggcttctttattttctgaaaaatctgttttggatatcctaacatttcgatcagctcataatcccagtcttttgtttccggggatactaactgtgtcgtggttgcattcgtatattctgatgccttctctcctgtcaaaagataattaaaatactccgggatcatcagcatggtctctgcgtgttcgagaatttcgggattgttggattttaccgccatcaactgataaatggtgttgaaaatctgcttctggatgcctgttctctcatataacttttcttccgggatgatctcatagactttctcatccattcctgctgtacggctgtcccgataaccgactgcatctccaagcattttattctctttatccaataggacaaaatcaactgcccaggtatcaatccccatactcaccgggctttttcccgcttttttacactttttcattccctctaaaattgctctgaaaagtgcttttacattccagcatctctgtccgttctcttcggtcattccattcggaaaacgatatatttcttccaataccatttttccgtcttccatatgtcctaatatgtgtctgccgctggaagccccaatgtcgattgcaagataatactgctccatagtttccccctctcctgcatctgtgttccttttctattttttattttaggaaaaaaatgagcgcaaaaaaaggggctgtgaaaaaagaatagtcccgaaaaaaagaaagaccaagagtttataatgaactcaaggtctttctttctgttataattaatttgtgaaaaaaattaataacataatctattctaacccaaaacaggcagttttgccaatgctaattcaagattatttggacatctgtgatccagtgctgacttttgatagatttatgggagaaatcgaactggagaaatatctgaaaaatattcctcaacattatacaggaagactcagatatgacccggtcagcatgctgaaaacagttttgtttggatttatggcgaatggctatatatcattgcgtgaactggaggatcagtgtaaagtcaatctccgcttcatgtatcttatggatcatcaagcaccttcttaccgtactttcggctacttcatcaacgaagtacttgctgattccattgaggaaatatttcaagatataaacaaaaaaatcttcgagacagagcatgtagatcttcaacatctatacattgatggatccaagtttgaagcaaatgcgaataaatactcctgggtatggaaaaaagcaaccgaaaaatccagataccgtctctttggtaaggtaactacactctttgaggaaatcaatgaggaactttcatgtacaggtatgaaactttgtatcaatagtgagtacgcaccagagtatctgaaggaagctgctgaacagtatgcagaagtctggcagattaatgaagcaatgtttgttcatggcaggggacatcgcaaaactacacaacaacgtcattatgagaaactcaaagagtatgctgctaagttggaagaatacgtggaaaaaatcaaaatctgtggagaagatcgcaacagttactcgaaaacagaccattcagccacttttatgcgaatcaagacagactacatgggcaatgaccagttgcttccagcttataatgtacaggtcggtattgcagatgaatatattgctgttgttgatgtaaatcagtatcgctcagatatggattgttttattccattaatgaacaagttttatactacatatggcttttatccgaagtacccagtagcagatgctggatatggttcttacaacaattacatcttctgtgggcagcatggaatggaaaaatatatgaaatttaccatgttcaagaaagagactacagacaagaagtatcatgaagatccatttcgtgcagtaaattttccaatcggggaaggcggaatcatgcgttgtccaaatgggaaaagcttttatcttcagtatcgaaaaaacgtaaaagggaacaagtatgggcgtcaggaagaagtgtatcagtgtgaagattgctccggctgtccatatgcagaacaatgtaaaaagacagataaaaaccgtactgtacggatcaaccgcgaacttacagcgatgcatcaggaagtgatagaaaatctcgaaagcatccagggagcgcttctaaggatgaacagatccattcaggcagaaggtacctttggtatcatgaaaaacgaccggtggtacaaaagaattgtccgaagaggaataaaatctgtattgcttgaagtatttctcgtttctatcggacacaatctttataaatatcacaacaaacagaaaaaagttgcagctgccgcataagatttcataatatcattcttatggggtaaggggaactatacccttttttatgtaatatagctattattataactataagcaaaaggacgaatgaaaaaactctcgttttttcacacgcccttatttgccaaaattattttcaacagagccactgataggttcctgcctccactgtctctttctttccgtctggcagaaccacttccgattttactggcgtattcaatgagatatgacagccatcctcctcatacttccaggagctttcaatttttcctgctcttgagagataacttccgctcacaccaccaagccgtctgtccggatacggctcgaaatgcaattctgcaaaacccggtttctgtggtttgattccgagaatatactgataataaaattctccgacactgccaaatgcatagtgattgaaagaaaccatattgtcgccggaacctgccattttctcttcgttgaccgttccatccggctttaatgcatcccagcgttcccacgtcgtggtcgcaccgcattttatctgatacatccagcccggacagccttcctgtagcaggatatcataggcgagttctgtctctcccgcttccactaaaagcggaagcagatgttccgtcgcaaagaaacctgtctgtaaaccatttttacggatattggcagcaaaattctttttcacctgttcccgcagttctccctccggcagtacaaattttaaagccataatgtaggcggactgatagtcttttgccacgattccctttttgctcacgaatttccggatatatgcttctgttgtggcttccatctgcctgcggtatctgtctgcatcagcttttttcccaagacgctctgccgtctcgctgatgaccttcagatcatgtacgataaaggcattcgataccggattgttgtgcattgcctgccatgcaatcccttttcccattgcaagccagtctcctaaagacggtccgatccagagatttttctttcccattttccggatttccgcctccacaaaaagtttcatgctctcgtactggcgtggcagtgcttcctcgtctccaaactgctgatagagcatttccggtaaaattgtgaccgcatttccccagcctaacatgctgataaaaccaattccggcaggtccggtctgcggcacagtggcacacacatacccttccgtgttgtcaagctgtcccagctccagatcacgcaaaaagtttttccagaaatcattggtgtcaaaattgtaggctccggtgcgtgcaaacacctgcccatccccggtataacccatacgttcatcccgctgcggacagtcggtcggcacttccacatagttggatttctgcccccagacctgattctcatataatttctgaaccattggattctcacacgaaaagtatccggtgcgcttcatatcggtgtgaagcgcatacgctttgatcatgcccggccgataatctgcgccggaaagttccatatagcgaaatcccatataggtaaaacggggacggtattttttcttttccgctccggcatgatagacgatagctgcctttgctttccgcagattggcagtgtaaagacttccatctgcatttaaaatctctccgtggcggattgtaattgtctcatttgtaaaaaaagaaggatcaatttcaacaattccggcaaagttctgtccaaagtcaagaatcgttacacttcctgtctgctttgcctcttttacctccatctcttcctgtaacgtaacttcggtcagcgtcggctccaacgcaaaatccagttcgtttttgaaagataccggatgtccgatcacctgatttcttccatccgcaaaataaatctcaccgtcatactccccggcgtattcgtaaggagattccagttcgtccgtctgctcgccggatacaatgtcccggacgccacccgcatcttcgatgtttaaaatccacgataccgcaggtttttccccgtaaatctgtgtcttgttctcacagaggaaacggccgcaataccagccctgtccaagataaacccgcaatgtgttctcaccctcacgaagcagtgcgctcacctcatgagtctggtaaagcacacgccttggatagtaggaatatcccggtgcaaacatctgtttcccgattttgacgccattgatctctgcctcgtatactccgagcgcagttgctgtgaacactgccttcttcacatctttcacggtaaatttctgttcatatacaaagacctctccctcgcggtactcacggtctgaggtgataaaatgcattttcagtttttccattccctgcgttttctcccttccagctatgctctaacaaacgtactgattcataaattctgcacttaactccatggactttaacggagaatcgtccacccagtttttgtggctttctaagatcactgcatccacattcactttttgtgcctgcgtgatcagcgaaaaaagattcatgtttccatagccaagttccatgctgtccgattttaagatcggtgtcatggcaggttttgacagtcttgttccacggtcattgatatggtaaagcttcattcttgtgtcaagctttctcatcagttccagtgcatttacgcctgcttctgttggccagtaggaatccagttcaaaattcacacacgaagcatccgtctcagagaggatcagatcatatgccgtttttcccggttcaactttcagaaattcacagttatggttatgatataaaagctccacgcccgcctcttttaaaatttttccggaagcatttaagtcctgacacaagccaaacactgcatttttatccgaataatcaaaacggtacattccggtaatgactacatattttgtgccaaatttttcagcttccctgataacgttctccggctctctttttatcgtgccaagatcctcatggatgcttgtcacggcaagtcctgcctctctcacaagggcattccagtcataatttccgccttttccgaccggcataccggctgcttttgtgagcattctgaccagaaaagaggtctgttttatcataaacccattcagttcaatgccgtcatatccggccgctttgatcctctttaaagattctgctgcctgtttttcattctttgtcacagttccaagcataatctgctgtattgcttttgtcatgttcgtaaccatccctttcctatgcctgatttttcgggattttctgtaatgcgtcgttgagcgctttcatctgttcctcgctcactgcgtctcctgcctgttttaaaaggctgactaatgtcatccgctgcatcatgcgctgcaacgccgggttatctttcacactttctgccacatcgccacggcttgctgaagcctgtgccatcagacgctgtacgattgcattcgccatctcgttctgtgcaagctctccgagcgtatccgagattgaataatggtctgccttaaaatcatcccggtcaaaccagttgacaacatctccctgtttgttgaatatataatccggatttgatttttctacttttttcacggtgatctcatcttcacaggcaccggacactgccctgatcttgtgtgttcctgtgatcgggacttcaaatttaaatactttagagccctctgctgtctctctctccacaccatccacaaagagtgtgacgctctgctcattggaataaaccttgatctccgtcacatcttcggtgcggtccacataacgtctgccgcatacatggacaaatggagttttgctccaatatgctttatacagataaaaggcatcttttttcagcttacggtcgatggtcacaagacctttctggttcacgccgtgttttccaccctcatctcttccgtctgccgcaaaatcaaacagattccagacatgtgttgcccacagatacgggcgttccccgatcatttttgccatatgctcatggtaaatacactgatattcctctgtgtaatcgccccgttccggatttgcactgtggtaagccggattggcgtctgcgccatactctgaaagtccgatcacacgatccgggtatgtattatgatacgcgtcaaagaaactgtcattctgttctaactctcccagataccagccaaaatacagattatagctgttcatatccgggatctccaacattgggctgtccgtctccagcataaacacgtctgccataaccgttggtcttgtcatatccagtgcatggcacagatcatttaattttctgtgattttccaataattcctcatttacggcacttgctgcagtgatctcattggaaagtccccagcagacgatggatggatgattgtaattctgaacgaccagctccctcatctggcttaatgtattctctgttccatctgacatgtgcatcgtaatgtacggaatttctgcccatacgatcataccgttttcatcacacagatcataaaattcctgcgcatgctgataatgtgcaagacggatggtattcgctccaagctcttttatgatctccatatcctcacggtgcatctcatttgtcagcgcattgcctgctccggtgcggtcctgatgacggctcacaccgcgaagcggataagaccttccatttaagaaaaatcctttctgcggatcaatggaaaaacttctgcatccaaaggttgtctccacgctgtctccatcagacagttctgcttttgccgtatataaatacggatcatccacgccatcccagagatgtacattggcaagatcaaacactgcttttgcgtaaccgttttcaactggagtttccttctgctgcccgtcaattgttaccgttactgcttctgcatctccgaccatccagagttcaaccgttacctttgcatccgcttttttggctgcggcatctgtcaaagtaacctccggtgttactttgatgccagttccacctgcataatccagttcaaaatgatttttcgaaacagttacaagcttcaccatacgatacagtccgccataaaatgtaaaatctgctttctgcggatatacctttgtgttatcggaattgtctacatacacttccagcttgttttcgtcttttaaatattgtgtaatgtctgcacggaaggctccgtatccgccttcgtggtgcactgcttttgttccatttataactacatctgccgtcattgctgcgccgtcaaactcaagatatgcttttccgtccgtttcaagttccggtctgctaaagtgacattcatatttacaggttccacggtaataatcatttccgccgtcctgtccgtctactgcattccaggtatgtgggagggaaacttcctctccctgcgtactgtccggatttttataaaaggtccagtttttgtccaataatattatttttctcatatctgtccagtttcctttcctgaagcatttttcttctatttcttttgtccagttattttcactttactgactgcttttttctgcggcttatttcatctcgtcaatcactttttcaacttctgcctgttttttctcctgaatactcttctgtacttcttccattttctctttggaaagaggactgtgccgcatcgcgcagagtgtacatacccagccaatcaatggcagtccgaaataaaggctcatcgtcatccagaaaattgccggtgtagacgggtcagatggctgtggcatactgtttttgtatccaattaatgcgacaagtccggttgcgattgctgcactgaaggaagaaaccagcttatcaataaagctatacgttcctgtcactgctgccggaataaatttaccgcttcggtctaactcatagtcaataatatctgccatcattgcattgcttgacatggtaacacacatttttgcaccatttaacactaaagtaagaacgacatatgcaatcatcataggtactgctgttgcaattaaagtcgggtcaatgaaaataaacaatacgataagaactgctgccactgtcatgcagacataagtccaggttaccatagactctttgtttccatgctttccggcatattttgcaccgataaaagcaaaaacaattgacggaagcattcctattacacttaaaatggtaccaagctgcatgttgccgataataataccaaaaagcatcgttgttacaactgcctggcttgcagtctggcttgcgattttgtccgagcttgctgctacgataaaggtctgtaaagcacggttagatttcactaattcgaccatatctttaaatttgaccggttcatttttctttgtggtgctcacacctttaaagttctccggcttgtcaatgtttgtaacaccgatacagcataaaatcagtccgactgctgaaactgcaacgcagactttacatgctgctgcaagcatttcaacagaatatacatttccatactgtggaagtaacataacagtaattacaatatttaaaatcataggtataaggtaattataggctgtgctccagacacctaccatcggtctctgcttcgggtcatttgtaagcattgcaggaacaatctgtgcggttacgttgcagagtgtgtatccaataatatagacacaatataaaacaacaaataatacaattccatgtccttttccacttgcccagcagtacatcataagaactgccagtgactcaattgcccagccaagtgctgttaaaatcctgatttttccgaattttgtattcattttatcaatgatgattgctatgattgggtccgtgacaccgtctaaaattcttgttgctgtaaggattaaacctactactgcggttgcaattccatatccttcatttgcaacatagcttgcaagaccaagcagtacataaaagctcattccaatcccggaaactgcaagacgcgagtgcaatctgccatgttttcgccctccggtaagttacaccgcctgtttctattttctgttcttttttctttccaaacatttccttctcctccgtttgtttttctcattttcctacatctgtatactatggacacccaccgtctgtctgacgttacaggtcttttttcgggaatttatatggtttttatgctgtctccttctgtaattccgccttcgttaaatgtatccacgcgtacatagtaatttttatccttaacaagcgccccaattctctttgcatctacttcattaccgtagaccagatagctgtgatacagcttgtcctctttatgtccccataaaatattgtatccaatcgcattttctgcttttgcagtcacgaacatgtccagtccgtctttacttcgttttaccgtaaactctgctttacccggtttttctccagctccagttccaaatacccggaggccggaaatgcatggcttctgtccatatggtacttcataaaccgtaagctttaagtaccggacttttattccttcttccctcacaatcaaatcatgcggcaaatcggtcacggcatcttttttatcctcaatcacttcgtaagttattccatcaacggagccttctaacttccaccttgtcaccaaatctctctcttcaatataacgcggctgggttttggttcccttaatttctcccggcaccggaatatcgattttatcgtctgcaaagttaatctgaatggcacggacatcgtattctttttgtaaatccagctttaaccagccgtcctttgtccctgactgccaccaggttgtcgcatcttcgtccaccgcaagcgccggttcttttcctttttcataagaagatgcctctaccgattttttatagcttaacaaataccactgtggattttcccaggcatctgttttcttttccgaaacagcaaccggccagtccccgtaacgctgattgcagaaaagttctccgtccgcatcaaaaccggctcgccagataccgacgcggcgctcaaactgatgattaacactgatccgcatcgtggacgtatgccagagatttccactcaaatcccacatcgtagagccatgtcctgcgcccggcataaatccacccgcatgatacgaatatggattattctctgccagtgtaaatggtccaagtggtgacccggaaacataaactccgtctgcatagacattgtattctgctcccggacacgcatactgcaaataatatttaccattgtatttgtccatccatggtccctcgataaaaggtttctctgtaaacattcctttcacaagcggtatcatttcttttggcagcatatcctctgtcatatgctgcattttcaaaaatccctgatactgctgttccacagcttcttgggaattcgggaaaatgctgttgtcaacgcccattcgttcatatcctctttcgaacgggttaccggaaataagcggtatccgctctccaagcggcttcattgtgatagggtctaactccacgccccagacaggtgtttcattcgaacagccccagtaaaaataaactcttccatcctcatcgaaaaacaaattcgggtcccagaaatcaaaggttccttcgattttctcataaggtccgtttatgatatcttttgtccgataataatcacagacctcaccttttttcgatgcacaaaaataaacataatccccgttcacccttgcgtccggtgcgtaatcatataatggaagattttccggtagcctgtggctttcccagtttaccaaatcctccgatacccagacactcaaattcatggatgcaaaaatataatactttcctttaaagcaaatcattgacgggtctgccgcttctctgtctacctgtatgccagtgctccgcgggtccgcattaaactgatatctgtaaggaacattaatcggattacagtaatacttcatctcctctgcctccctttttcttttgttaacttctttatctgctcctattgtatctgtttctatgctttcatgtgtttacatattcgtggaaatgtaataaaattcgcgttatataaatacattgtaataattttctaacattttactgattttatgaacgtatgatttcataaaatattctattattaaggtaacgaaagatcggctttgtgcaatttgacaatcaaaaattgaaatagcaccttttgacacccgaaaccgaaaaatactttactttaaaaaggagacaaattttatgaaattaccagagaactttttgattggcgcagccaccgctgcccaccaggtagaaggcaataatattcacagtgatttatgggcaatggagcatatgaagcacaccagtttcattgaaccgtcccttgatgcggtcgaccactacaaccgctatgagaaagatattaagctgatggcagacgccggtttaaacgcgtaccgcttttcgattgaatgggcgcgcatcgagccggaggaaggacactttgacagcgaggctgtggaccattacaaagcagtgattgcctgctgtaaaaaatatggcatagaaccatttgttacactccaccacttttccagcccgaaatggctgataagcaaaggcggctgggaggcttccaccaccccggaggactttgcgcattatgtccgtttcattatcggcgaactcggaagtgagcttcattacatctgcactattaacgaagccaatatgggcattcaggtcgcagccatcgcagagcgttacaaacgccagatgatggcacagatgcaggctgcacaatccggtggtaacagtgccgacggaagcgttcaggttggtatcaacctccagaaaatgatggaaggacagaaagctgccgccgctgaaaacctcgaagtattcggtgtagaaaaagtcgaaaacttcacttccatgcgtaccagagagggcgaccttctgattttaaaagcacatgagctggcaaaaaaagaaatcaaagcactttacccggacatcaaagtcggactgaccttaagcttacatgatatccagccgcaggaagacggcatggagcgtgcgaaaaaagaatgggacgaagaatttatgcactatcttccttatataaaagatgacgatttcttaggcgtacaaaactatacccgctccttaatcggtgcagacggacagcttccaaacccggatggtgcagagcttacacagatgaattatgaattttacccggaggcattagagcacgttcttagaaaagtagcgaaagatttccatggggacttatatgtgacagaaaacggcattgcaaccgcagacgatacaagacgtgtcgcttttatcgacactgcattaaaaggaattgtttcctgcattaacgacgggcttccggtaaaaagctacttccactggagccttttagataactttgagtggcagaagggctactccatgacctttggtttaattgcggttgaccgcagcacgcagacacgccacccgaaggaaagcttatccttcttaggtcattggaatcagtagataaaaacaggaaaggaaaccaaacatgaatattaaagaacgtctctctttttttcaggaaatagtacaatgtgaatacccgcttcacctctggagatatgatccggattttgagctgcttgagacaaactgcccagcagaactaatgctgccggatattatatccatgcttggtttttcttctcttatcctctcccacattgagaatggaaaacgtcttccgcttgttctcgatactgaatttggtcttatatggattgccggatttgaatatcaggggtttgagctgaaacagatccacatcttgggaccggcctttaccggcagcaactcccatctgatcctgcgcaaaaaattagactcctaccagcttaccgtgaagctgcgctctaaaatcgtccgacagattgagagtgttccaatcattccatcttccacactgctctcctatgccgttatgtttcactgtgcgattaccggagaaaaaatatccgcagacatgattttcttctcctctcacagcgaagcaacggacacagacgaacttacactcattgccgatgaacatcctggaatctggatggcagaacagacctttctttccatgatccgtgagggaaatccggactaccggagggcactcggcaagtccatgaccttaagctctggcatgaaagtggaacttggagataccctgcgtgccaataaaaataatctgctcgtacttctcaccctctgcagccgtgccgccatcgaaggtggattaaatccctccactgcatataccttaaatgattattacggaaagcggatcgaggaatgtaaaacgactgccgacaccaacaacctgggcaatgaacttttagacgattatgtcagtagagtccgcaccgcccatgagacggatgagcacgcaaaacaaattgccgatatctgtgattatatcacgcttcatatccgggagcctttatccatctcgcttctctcgaagcggcttgggtacaccgaatattatttttcccacaaattcaaggatgtgatgggaaaaagcgtcaacaactatatccggcagaaaaaaacagaagaagccaagcttctcctgtccggtacacatatgtcgatttcagagatcagcgatgagctgtcattcagcagccgcagcttctttttttccagtttccagaaggaaaccggcatgtcaccgacaaaataccggcagctctatacaaaatcataaaaatattttttgctgtctttcactcactgatacgatatctgcgcggcgtcatcccatattttttctgaaaaatccgatgaaaatagctgatattgtcatagccgaccgccatggagatatccatcacattcatggctgtcgtgcggagcagatatgctgcctgactcagccgctttgcctgaaccagatctgtataggtctttccggttcttttcctgatctcctttgaaagccagtaaatatcaaaacgcagctcctctgcaagctctgtcagctcaccgcttttataatgttcctccacataactcaacacctgaataataaacttctgctgctcactggctgcatccgtctccatcatctttaacccatagtcaaaaaattccggaagaatgataaaattcactgccacatccccttctcctgccggataaatctcctgcacggcattctggtttaaaataagcagttctccctgctttaaaatcacatcctccccattgatcacatgatgcgtgctgccggaacacatgtagatcatctccacataattatgggtatgttccggaaaatgaataaatctcgtatgtgtccgcacctgaatgagttttcctgcctccaaaagctttgtggcatcgatcacattcgagttctcttccatataaatttctttttcaatggtcttttcaccggataaaatacgctgttcttcaggtgtgatctgttgtaacttttccagaatttcccctgtcatcgtttcctctgctccttaaaatacgtcatcatctcatgtgtcagacttaacttctccttatcctccgggatatcatgataatccacccactctgccacggagagttcttcctcgtctaagcggatctccccctcctctgcaagttcacagaaatagccgagcagaagattgctgtcaaaaccccacggctggctcttatagtaacggatattcttcacggtaagtccgacttcctccatgacttctcttttgaccgtctcctctgccgtctcaccgatctcggtaaatccggcgataagcgcataccttttgtactctcgtcccgcgtattttgtcatgaggattttatcgccgtgcgtgactcccacgatgactgccggtgcgatcttcggaaacaccatgttcgcgcagcacggacactgcagcatccgctgcatttcgctgtgaaccagttttttcccacatctgccgcagaactgattgtcacgataccacacaaataaatgccatgcagtagcagctgcgaggacacgttccttcggctgcattggacggacatcaaacatcttataaaaacgaaactcgccaatcttggtatccgctcctatttcagtcagaaagtattcttcctcccctatagaaaaaagataaatacaagacggcacttctcttcccagtatattttcgttgtaatccttccactgctcataagtcaaaaactgcaattctccattatattccagatataccgttcgctctccaaaaccaaacatcctgctgcctgcatgcggtactttctttttatatgaattatccaattgcattggtgcaatatcctgtatcatttccttagattcctttcattttgaagcttttcctattgtaaaacattttgattttttgtacaataagattatattgttgtaaaaaaaagaggctgccggatcatggctgcttccaaggggtttttatcatgtatcacaataaaaaaatcgggatttttatctcccacattatgggattttaccagaagaatgtatgtcagggtattattgacaaagctctggaatacggttacactgctgagatttttgcttctatggatggggagaatctcggggactacagtctgggagaggaaagcattctgacattgccgaattttgatgatttaagcggtgttatttttgcgtctgaaacttatccaaacgaacagttaaaggatcagatctattccctgctgaaagaaaaatgtcactgtcctatcatagagattgctgtttataagcagcagtttccttcggtttccttagaaaataaccatcctttttttgatattacagaacatctcatcacagaacatcactacaaaaatatctgttattttggatgtgccgatgagagtttcttttcggatgccagagaaaagttttaccgggacgcattaaaaaaacatggcattgcaccacacgcacattccatctataccggaacctacactgcgcagtccgctgctgaagcactccgcttctttgaagaaaatgaaacaaaaccggatgcggttgtctgttacaatgataaactggcacttttattaatgactgctgccatctctgccggttatcatattccagaggaccttgcgatcaccggctgtgaccacagtgaagaaggacagaatctcacaccttctctcacgaccgtctctttccctgtctatgaacttggggaagcttccgtagaaaaactgatgaaattaatccatgaggaaaatgttcctgccatcactgtggtacatgcacagatggttctggaaaattcctgtggatgcagtcttacaaaagagactcctgctatttactttgagcagaaactgaccagtcagattgcttctctggagtcttctattttaagttccatgaaaatgtctgctgaattccaaaatattgccgacatagatgaagcgatggatctgttggagaattacgttcattctattccaaactgttccgaattttatctgtgtctgtacgccaactgggacagcgtttcccagcacatactggaattaacggaaaatgaaatggattttgagccaagtcaggatgagattattttaaaattaagtctgcgggatggcaaaagactgccggaatgcagttttaccaagcgttccctcctgccggaacatatctacagacagtcagattctgcctacctttattttccgctgttcttcaagaataagacttttggctatattgccttagcttacgagaacaaccgcattgactatcacttccagctcgtgcactggttcatgaatatcaaccagttattaaaacgtttgagtgacgcaaaacgtacttccatcctcgtctctcacttggaggacatttacaccaaggatgcgctgaccggactttataacaaacacggctatctgcaccgtgaaacgctgttacttcaggaagctgcagaaaaccaaagtactgtgacctgttttctgtttgatttaaaccgcctgaaatatatcaatgaccactatggtcataatgagggggattttgcgattcaggtcatcggacatgccctatccagtgtcacccgttccaccgatatctgcgcaagattcagtagcgatgaattttatctgctgacaatggattacacaaaagaagatgccgatgaactcctcacccgcgtctataagtacttagataattataataaaataagccacaaggaatataatatctctgccagcggcggctatgcccagtccacaccgggtgcatccctttccaaagaagatgtcaaagctttattttccaaggcagatgaacatatgtaccagcaaaaacagatttttcatcaggatttggataaataagcattgtgacggtattctgtcggagatactccacaggttgctttaaaaattttcataaaatgcttttcattgtcatacccgactgcctgactgatctcgataatcttcatatcggtttcggtcaggagtttttttgcctctctcatgcggatttccttgagataattcacaaaattgcttccggtatactgcttgaatgagtaggaaaacagggagtaattcatggaaatataattggagacaaccgccatattcagatcctttgcataattttcttctatataatccacagccattttgattttctgtacattcttgttctggtcatagctgctattgatcttctcatgaagctgcaacacaaattccattaccttgtcctcgtaggaatcgatacaattttcactccagatttctttgcattccaataaaagttctccctctgtctctaaagcattctgataggttttctctacctccgtaaagaaatctttcatacagctctcaaaaacagcctcatcaattcttccatttttcacttcataaaagaactgatgaaaactcttttccagatcgtctgtatgatctgttccgatcaactggacgcgttggattctggctgcctcctctgtcaacttagcggcctccgtgataagaccttccggtatcttttcctgaaatacaccgtactgcgcttccactttattgcggacaaatgctttctttcgcatcatgacagactccgcatatgcctgacggatgctctctaagccacaatgcgccgcactgattccaatgtaaccatcctgcaattcgtttttcaataagagggaaaggttctctgccggaacaataaaaatatcattgtcattcatatttttcatgaaaatataattatcgtcggacagttctcctctcttgacctgattctggcagcacacataataatttccggtataaaaatgatctgcatactgactttcgattgtgcgctgttcctccccggaaatctcatcggaaagcatcaggtgccgcatctgctgataaccaattttctgattgttctcctctttctctttccggctctcaatctctgcattgagtttttttaagatttcggtgattttttcacgctcaatcggttttaaaatatactcccgcaccccgtttcttaacatttccaccgcataggcaaaatcatcataaccactgattgccacggtaagtggaatatgttcgaggctctgcattttctgtaccagttcgatgccatccatcttcggcatacggatgtccgtaaacatcacatcaatctcctgctctttcagaatttcaagcgcagtctctccattgttgcactccataatggtctcgattggcacaccacttcgcataatcattgttttgattccctgacggatcattttctcatcttcaacgatcaaaactgttttcattatcttccttaccctcttctaatcctgtatctctcttctgtcacagtcccctgtgcctttatttttcacttatgctccgggtcattttcctctgactgtctatgcgtgattggaatccggaccataatttttttgtataacaccccaatttggatgcgatctcgattccatactgatctccaaatgcaatatggatacggtcctgtacatttttcagaccaattccattgccggagcctccgttggaatcaatttttcctgcaatctttaaccgaagcttctccacttcttcttctgacataccttttccggcatctgtgatctcgatcacacagtcatctccgtctaaaatgcccttgatatagatatttgtgtcctctgccatctgttcgattccatgataaatggcattctcgacgatcggctgcagggacatcttcggaatctcctgttttaataccagttccggcaggtttaacgacagataaatctcataatcaaaccgcagattgatcagagccatgtagtttttaatgtactctaactcctgctccacaagcacatttcctgatacccacttcatactgtaacgcagcagtttccccaatgcggtcaccgcatcagaaatggcgtattcttcatcaatctctgccatcatcttaatcgattctaacacattataaataaaatgtgcattgatctgattctgcaaagcccggatctcagaattttttgctaacatctcacggtttaaattatcttccatcagctccttgatacgttccaacatcttattaatctgcgttccgagttcgcccatctcatctttgccacagttttcgatcacgacatcaagatcacccttctgtacttttcgaatggactttaagatctcataaaactgctttaacagatgctgcacaatacggttgataaagaacgccagcaatatgataaatgccagcatgacagccacaaacacatcacgcataaaatatacattatgaacattttttgtgatatccttcacacagatcagtgtaccggagagtttgcgcacctgcatataagagattacaagtttttttccatccaattttttataaatggtctgtatcttgtcctctgtgggacgctgttttaaaatatcgtcaagcagcgctgaagattctgtctgctctttctgtccaaaataggttactccctcatccgaataaaagaaactccactcatcctcaattccctcgtacaggcttggaaacatattctccatcgtcatggcagactcgatcacaccaacttttccattggcactgtcaataatcggtgtgacaagtgaaataatcttccgattctggttcatcgtataggaattgaaaatattatctgtgtaatcaaaattccagccgacatatttatcctgcttggaccactcctgttttttcatacgggatgcattgtataaaatgggcatcatctcctgcacactgtcattcaccgcatagacacggacaccatacagcaatgggttattgttaactaaccgttccaacgccgacacttcgttatttttaaaatccagccagtcggccgtagagatttctcccccaatcgcagatgcattcaacatttgaagcagggaatcatcacttaagaaaaactgtgtggacatattgatagaatcaatctttgtcttgattccatcctcattccgctgcattgtatattccatgtaatccatgttctcctgcaccgcattctgctccataacatagaacaaaacccctgctaacaccccgattggaatcaccataaacagaatgataatactggtaaatttgatatttagctttgtatttcgaaacagctctcttatttttttcattcgctaattcccattttttcctttgctgcattcattaatactgttttctgtttcaaaacttcctgatagcccatggcattcctttttcccacaaattcttcaaatatttcatcaaactgtgcttcatttgatgcgagaagaagctttggcagtgtctcactccagagtttggtacatttttcatccatagctgcaatttcaggacttgtcgacaaactcacatcatactgtccattgtagactgtatatttgcatgcccacacgagtaactgttcagtagcaggacctgccttctgctcccactgaagttgcatgacattattctgcagcatccaataagcatcatctgcgccgtataacctgtcgtaagtctcccggtcggaatttaaaattttgctgacgtcctcttttaataccggcttaccatccacgatatcgtaagtaaccccttccacaccgagatagatcaacatctgtccatgctcactcatcatatagtccataaacgctatggcgcgttccggatatttacaattttttgagatcagcgtcaatgtccatccattcatattgttagtcggcagtgtcggatcatccccattggaatttctcggtccctcaaccgccatgtaaatgctgtccggatcattctcatacaatgctttttgctgtgagatcgtatcactgtactgatagagcatacaaaaataccgaccttttgccagtttttcttccatctgtatccgtgtatccacaaagatatcattggcaagcagcccttcctcccccagttcacggaacatttttaaccatataacatactctgggtctgtatatctgtcataatatttcccatccttttcccacggaaccgcaagaaaattcatcagatatttgtcaaaggaaacatttccctgattatcaaatacatgggatcccaccgggatcaatttttccccattcacctcaggaaacatctctgccgctttctccactgctgctttaaatccttccggtgttgtcatatccggacttccaattgcctcataaatatctttacgtaccagaaacgtctgattggatatgatgtcatcatgctctttcacctgttttggtgtaaccgtggaacacggatatccataaatattgccatcatccattgtataccagttcaccacatctgcatctgtgacctgccagaaataggcatcataatcatctgcaagttcatttaatgcatagaccatgttctcttcgatcatctggttcacctgtggctcccaataccctaatgtgatcagatcaggcagagaatccgatgcgatcagtgcatttaatttttctgtttcattcccgattggtgtaataaaattaatatttactcctgtctcctctgtaatcttttgagagactgcattctctccccacggtattgcaaaccaggaataattgacataccagtctaacgtaacaggttctccggcatattttttccatgccggtgtatcctcatcaccctgtgaggtgtcctccacctgagatgtctccacagcctgtccttctctttccgctccgcagcccgtcaaaacatttgtcatcccggctgtcatggtcactgccatgccccatgcgatcatttttctgattctgtatgtaaccataaaacttcccctttatttctgtttccaagtatctttatcataccattttctttcgtttcccgcaaaccccgacagagcaaatttcctgttttcatgacattttccgagttctttttactttctttttaaacacacaaaagcgctaccccaattttttgagtagcgtttctgtttttatctatttagagaagaatatggtaaggaaactattttatgtactgtcattattcttttacagcacctgcagaaatactgctgatgatgtatttagagaagaatgcaaatacgagtaaaatcggaataacagaaattgcaacggcgagataaattgcgccctggtttgcagtaatatctgttgatgcccttaaagttgccatcataaccggtaatgtaaatttctcatttttatttaagataatcataggtaacaggtaagcattccatccaccgatgaatcccatgatactcatggttgcaatcccaggtgacatgattgggattgcgattctgtggaatgtatataactcgcttgctccatcaattctggctgcctcgatcagtgaaggtggcataacggaaagtacatactgtcttaagaaaaatacggttcccggtgaagcaattgccggaataatcaatgggatataagagtttaccagatgaagtttggtacataagttataaaaaccgatcagaccaagctgtccaggtatcatcatgaaaattaaaatcgtcatgaataatactttatttcccttgaatttgtacattgccagtgcataagctgtcatagcggaaaagtatgcacagagtaatgtagatggaactgctactttcaaactgttccacatacctaaaaacaggttgaagtatttaaatacagtagcccagttttcttttaaataaacactcggaatcagagtaaatgatttcataatctcagatccgcttcgtgttgcgttgacaatcattaataaaaatggaaacatacacactacactaagcaggattagtaagatatataaaattgtttttttgattttatatccaatgccgttcatagtaatcctccttatttcgtcttagatgaagcccgtttttttgcacggcgtgctgctgctttctcttcatcctggttaaacacttttaactgtataatggaaacagctaaaatgataaggaataatacataggcgattgcggatgcataaccagtctgtgttgttcctgttgtaaatccaaatttatagagatacattaccacggtgtatacggagttataagatgcccctgccggatttgacatcagatacggcagatcgaacatctgtaatccaccaatcagtgatgtgattgctacataaagtaacatcggtcttaataatggtaatgtgatttttccaaatacggtccatcttccggctccgtcaattgctgctgcctcgaaataatcttttgagattccctgcacaccagccattaacataatgaaggagttaccaaaccacatccaggaactgatcactgcgatggtcacacctgctgttgcagatgatccaagccagtcgaccggagtgtaatttgcaccaaataaccgatagatgcttgcaataatctggttgaacgttccataacgccaatccagtaatgtctgaaataagaatgcaacagatgttgctgcaattaagttcggtaagtaataaataatacggaaaattccaagtcctttgattttgtatttgatatcactaaatacaatggtaagtaaaaatgcaagtccgagctgtaatacgatattcacaccccagatccttaccgtgttccaaagcgctctccagaaaaatttgtctgtgaatacacgcttgtagttgtcaaaccagacccaggatgtcacaccgactcctgcaatcttggcatttgtaaaactgaaatataaggttcttaataccggataaacactaaaaatacaaaatacaataacaaatggtaaaacgaagaagtatcccacgttatcatattttttcaaaccatttttattctttcccatattctgccattctccttcttcataactatctcagaggatagccattcttttcctgtactcttttgtcttttcttacagtctgcacattcactgtgcagactgtaagaaaaatgattttggagatatttttatctgtttactgtgatttcaggatatgttgcttcaattgtatcgtagaagtcagagattgcctcatcctttgtcttctcaccagttttaacagaagagattgcattgccccatgcatcgccgatacctttgtcgtatcttgttactttagaagtatcaatgtactgtgcctgatctaaccagaactggtataatttctcaccaccgtaaatctggttctcatcatctttgtgtttatcaagagctgatttcaaagaaactgtatcaccctgtgagtattcaatccaccagttagctgtatcttcatttaatgtacagaattttacgaattcccaagctgtgtcttttctttcagactgagaagaaataccgatatatgtaccaccgtcaaatcctgctgctggtccagagcaaacgccccataatccagatgtctcgcctacgttatctctcatagtaagtacaccccaggaaggaagaccaaatgcgaatacagttgttgtatcaagtccttttgttgcctctgcgaactgatctgcatcccaaacgttaacggaatcatctgcattagactggatatctgctgttaagataggtacctcgccagccatagcctgataccaaggtgttgaccactggcttgcatatgctgttaagtcattctgatataagtcaacgcaaagatccatgtaatcaattctggactggtcaacatttaatgttccatctactacccatgcactatcaccggagaatacgttcatctctgcatcagaagagaagattctgtatccagcatcttttaatgtctgagctgtctctaagatagtaggataatctttgaataattttccaacttcgtccggatcatctgttccgaatacttcttttgcgatatctcttctgtagtagatacctgctggtgtgatctggtaagagattgctctctggataccatcgtcatcctgtccaacctgccatacataatcaacgatctgatctgcataatcctgtgcattgtatggtgcctggtttaaatcctcgaagaaacctgcatcaaagaaatcctctaacatctttggctcaccaacgatgatatccggttctttttctcctgcaagtaatgctgtctgaacttttgttgggtaatcagctggctcgataaccactgtatcaacctctacaccagtctgttcctggaatctcttaccaaagtcgatcaagtcgtttgataatgtccatacaactaacttttcatcgctggatgcatttgctgtgcttccctttgtctctgttcctgctgctgcattatcgcttgtgcttgctgtgtcgccacatgctgccatggataatgtcattgcacttacgagcaatactgatactacttttttccaattcatatataatcctccttgttttacgaagcaaaatccgaacccattggtgaggagaggattttgcctccttattgttctgcagaaaagtgaatttgctttctgctgttacacaacactttgttgtttgttgataattgaattataagttcaatcccctcttgtaaaaatgctttaaattttaaaatggtgtcttttttttaggtgtcctttctcccatcagcgcagattctttttctgtttcttcccagaactttttgttttcgtagtccgttgtgataattttcatgcgatattgtactatgtgtgtcgttcttatcgaacatcaatctcaatggatgtcacaagcccctcacggacatccactgctattttttctcctgcaacgccgctgcccacattggcaacgcttccattctgatagataaacttcatggaagcaatctcataatgtcccggaatgtagtcggtgacatctgcaaactgatacgttacctttgtctttccaaacagcatggcagatacttttccattttccggaatcagatatgccggtaccgcaggctgtggcgtgaaatgcagttctccatttttcatggataaaatatggctgccaaacatcatctgtttccacatactgataaactcgatggtcgatccacttaagcgtgccacaaaacctttgccgtgatatgctttgtttggatttttactgcttgcgataaaggatgaattctcataaatacttcttccatatacttccttatccaaaaatgggatcgcagctttgtggaaatcctcaaaaaatgcttcatacatgccatttcggatgagttccaacagatacttatattccatatgaagccagatggactcattctccagccagccaggtgtgaaggctctcgctcttccaagttcaaaggatgcattctgcaaagaagcattgaccttatacatggaaagtttttcatcatagagatcactgtgtctcacctgctcatataattttgcctttttctcttttccggtctttaatttcagataacgaaccggtccttccaggaaatatggaacttcacgaaccataaattttaatggcttgtagccgtcttttactttctcatactctaaaacttcataagtaaaataggtcgggcagataccatttcccaatatgcatgctttttcaattccgcaggttactgtttccagaaaatcgtttaaaatttttacaactttctctgtggaaacaagattcttcacaccggatattccggagaatactttctctcggtaagcctcttttgcatcgttgatctgattccagaaggaaaggatctcaccctctttctgaatctcttccttagctgcatagctctgctttttgcagaaaccgatcgcatctttctcacttgcattgatcagatcaagctgctgtaagaaatcagaaaattcttcaatcagttccagttctcccggatatcgttttaatgccccgatcgtgtattccaacattctggcaagctcataggtctctgccatggaagaaccaaacatgcccggcataccatttaacgcgtcataccagccaggttttccaccttccatctccacacccataccgtaagcgtccagcgctgcaaattttgtggtgcagagtaacactaatttttccagcagcgtcatctttaaaacttttccggactgatttgcttcacgcaccagtttttcttccgtatttctacggctcttttcattcaatgcataatattgtctcaggccattttccgtctcttcatagcgactgtatctcggattgatatttacccgtgaaaggaacgtcgtataaactctctcatacagtaattccttctctttttccgggaatacttccagataatcttccacaagatccagattgtaagtccagtggtcgctccagtagccttccaggaaattgccgttcacaagtccatccgcctgatcgagcacctggaaaaacagattttcggtctctttttcgccaaaattctcttcgattttccgatataaggaacccggtgtgaatggttttttgatatattcacaaaactcctgtttttcctgctcggttgtaaataaattttcgtgaagagccagcagactgcctgctttttcttctgcaacctgataagtcagtttttccacgcccagtgggttataaccatctagctggatcaggctgtaaaatgttttgatattctcccttcccacaaatggtgcaaagaaagtgtcacatctgcggttctggttgacatcgcggaaatttccatttccctgtgaatagaactccggcagcatggaaaaatagttgtaatctctttccagatcgccatgctttctggaatacacgtaaaaaatcttatgactgccaagccggatcggatatccgcctcttaggacgttatccatataagtatactgacagtaagcatcaaaatctttcgacgcagtctctgtcgcaattccgctgcaaagatgttctaccagttcctctgcctcttttgcttttgcatgaaaataagccgcgtccagtttttttgctgcatatgcttttaataagtctttgttctccacctgtccgatgatctcatagaagcaaatgctctcatccgcagcaagttctgcctctgttccataaaaactgcatggcagctggttcatggtaatctgctcttttaccaacagttcttttactgcagtcccttcaaatccaatcggcttctgtaaggaagtatcataggagaatacaaccgtcggatcaacgaccggctgtaatctcgtgccatcagaaaggcatccgatggaaaaattgccgccctccatctttgtgactgcggcggtatctgccatgctggcacgtaccctgaaatacggccgtccctctttcacatcctcgacctgcatccacgctttggatgtctggcacatatttttcatactgtcaattccaaccccatatgggatcagtgccggcatgccgtctaatacttctattttggcatattccccggtggtattggtcagttccaccctgcgcaccagcgcaccgattttttctcccggaagtgtgaaatagtccacctttgcattcacgccaagtacgtcattttcctcttcaatttttaatccgttcctggcaatttccatgcggtgtgtccggttttcatctgaaaaaagctccgtcacttttccatctttttttacaaaagtacggaatcctgtcgttttcacattctggtacgcctgatgtgccggataaaattccatgatcgaatgatctttattgtcgactccgaaactgaccacgcactgtccacggtttacataatagcaccagataggaattcccttctctccggaaatgcctggaagaaagcttgcaaacgtgctcttttttccatagttttcaattaaaaattttttctctgccatattcttctccaatccatttttcgcaattgtttataatgtaatattttcctaggcaagaaccacttcgatcagatgtgtctcattgccagaaagtttctcgatcatattcttaggaagaattgcatcatgctgttttggcacaaaatttatcttctctccgtccaccgttacatctgcaatctgatattctccataatccttgtcttcacagttcaaataagtgatcttccagtttttgtctgcaaacttcagtgtaagggatgcctttttctcttcatcaaactgctcttttaaaagttttgggtctaagatcatatcaccgatctgacctcttactccgaacatctctgtgatcaccgtcagcatataccagctcgcagcgcccgtcagataatggtacataccgcgtcctctgccattgaagtattccggaattccaggatagatgtggctcacttcgaagtttgccgactgtctgtacaatgcatgcaaggacttacaaccttcctttgcaaatccacgtttgtaaagcgcattggcatacatcactgccatatgggaaaagactgctccgttttctttatctccgtaggaaaatccaaacattcttccaagatctgtcttgacttccccgaaatctgtgttcagacggtagccacccactttttcatcatagagataacggtctgcactcttcgtgatctgccggatttgctcttctgttgcagtgccagccatgatggaaaatacctggccggttaacatcatgcggacaccggtttttgtatctccttctacctgacgtccatgattatcatagtaaccgttaaaccagccgttttcttccgaatcctttacccactcatttttccggatatgctccattaaccactccgatttgtgacgcaggttttcagtcagtttttcaatggagatctctactttttctccactcgtatcatgctcacacgtatgtaaatattcctctaatacatgcagcttcttctcaacagaatcgtataatgccggattatcttctaaaagaatcacgatctctgccagaagggaaaccgtttcttttccagttttcttctggtatgcctccagcaattctgcaatatcggcaaggttgcctgcataagcattggaaaatgccacgctctcgcccttctcagaagccatatccagcgcatcattccagtctgcgccgcgcagtcttatgttattgtgttctccaacttcataaaaagcggtaagattctgtaacagcagatgctctaaaatcgtaccctcttcccgcacgccgcgcttggtcttctgccagcagccataggattcatcccacagtgtatctgtcctggttcctcttgcaatctgtttgtctttaaaataagctgcctctttttctaacagttcaagatctccggtctggtcaatataaaactttgttgtgatcattggccatacaccatgatccatccacactcttgtgatattattccggtctgcaacaaactctccctgtttacttccgatgatcgttgcattacttccatctatacggacaccggcaaagttatcaagcagtatctgtcttactccatccggattcataattaaaagtgccagacaatcctgccagagatcacgccagcctcttcctccctttccgtaatcatgatgcggaaggaaggaacagccataaatacgacgcagaattggctgaaagcttacccagtgcataaactggttgaaatctgaatctccggtatgataagcaacatttactttttcctgccagtatgcttttgttttttccagttcttccagtactttctctctggtcgtataagttttggaaagattcctgatctcctgaatatcttctgtaattccggtaaagatcagataactgcattcctcttccggctctaatgtaatctctgaaaaatgaagaccaccaactgcctctaatccttctatctttgttcctgccttgaccccctctgcattttttacaatggcatatggtctctcaaagttaccgccctctccgacaaaatcctctgctgtcggataaaaatccaccggcttttctccattgccactccagcccacgcagtaataagtcatatggttgacctgatgtcctctctcatcgaaagacaatgtcggtgtcaccagaacgcctgtgtctgtagtttcgattctatgtaataaagatgttacatgtctgtggtcacggatattgtccgcgcttcttccatataatggtatcgccgccgttggtgtaactgtctgcgccatgcgtcctgtgtttgtgatcgtcaccagcatgatctcaacgtttttatctactggaataaaagaaagtatttctccgcgaagctgatactttttggattcccttgtcgtcttctgccacataaatccggctgtcacttcactgtcatcctgcatttccgtaaatttcttacttaactcttctgctgaatgaccagtcaaagaccagcttccgattcccttcacattgcaccagaagtttctgctgtttcggttattgacaagattttccgcacttaccggctccagtaaaaatgtattctgatctatcttcgcatcaccgccgagattcggtgtgaaggaactttttaatcctgcttcccctgcaattggaaaataaagatagctgatattttccgcttttttcaaatggaatgttccctgtgtatcttcaaattgatatcctttcatcctgattctacccttcctattttgatatttttattctaagaaaaaacaagacacaaaaaaggacactctttttcaaaaaggtgtcctttttttatatcttaccggatcagaccgttctcatattcacagatcacttttcgttctcctgcaaaagtcaccgaatctcccgattcattgataatatggttcatgcccggatatccggtcagcatcacggtacagatattgtgtactttcactccattcttatccggcacctccatggcggtgtcaagttccacagacgcatcacggttatacaggtaaacgccaagcccccatgcctcaaacgtatccacagcatcatccacataaaaagaagcgtatccattcttctgtccctcatggctcatccaaacctcctggtttggaacatcatatgggatctcgctctgatacatatacacttttccgtgatctccattccataccgtctgatactgttcaaaatgttctaccatcagcgcatacatcgtgacatcatccccgttgatgatgattccattttctgcctcgtttttctcccacgcaacattgtctccgtggtctgcacgccatacccagaagttatccccgaccacatggttgctgttgatcgtagcgcagcactttacgcttaccggtgtgtctgtatctgttcctccgacatggaaaaacagatcgcttaaataaatattttttccattatcctctgatttctgaccctcgttaccgatgacaagaagattgtctgattttatttccccggcatcaaaaagtaatcctgcaaggatcagtccctgcacattccctgtttccaggcagacgtttccttttgctgcacgcagggttgccagtcccatgccaagcacgattgtatccggacgatttacagcaatcggttcctcaaggtcataaattccaggtgtcagaagcagattttttccttcttccaatgcctgattcatcgtctctgccgtatctttctccggctttgcaacataaaactggtcaatcggaattttttctccctcgctgccattttcccatgaaacaccgatagcattttcccgctcttttggcacatagaccatataaccttcctcatcatcatagatcaaaaacggtttttcctgcatggcttcggtcttttccacctctgtgtacggaacgaccggccaggttccggttggattttttccttcctctgtgccgacaaagaccatattccagttagcccccatccacgctttccagttacagtttctggaaagccattgctgctgtgacccggaatctgtcatcaggtcggtgttggagtccgccagaaatccgccactgcaccatccgtattcatcatgcagaaacaatgcaccatcgacctgcactctccgcataaacgttgcctgcgagactgcccacatcgtgttcgttttcagctcgatgttttccactccgcgccagaaattgcagcacgcattgtgattcgacggatcgtccgaaagccatcttgcggtacattgcaggctctgtaattttgtgtcagtcggaagttctccaagccctgccacctgtgtataaaacccaacatccgcctcgatcgtctcgtcatactctcccggcataaaatagatggcataacgcgcctccccaaactgatctgcttcctgtttctcataaatagcatccaatgtttgtgccacctgccccggatcatcctccggcgaaaaaatataggtattttcgccaaataattctgtatgaaactctgcatcccttgttgtcatatcttttgtatccattttactgctttcctttgttccacaccccgtcataagcatacacgctgccccgaataaaagcagcattttcccacagtgtccttttttcatgattttttcctccctctcccttatcagcataacggtatccgggcacaaaaaaaggacaccttttttcacaaaggtatcctttttccatatagaaatatttttttaaaagtactccataataaagtttttctttggataaaaaatctgcccgatggttccattctgtattaccttctgatccagtatctctaccgaatcgtaatctgatatctcaccctctgcaaatccccggaaaataccgtgtgcaaaatctgcaatatccatggtaatctacggcacctgatcctgtggcatacgctcaatcgcagtcagtgttccgttggtaaaacgaatccagtaactgccgttattttgtggtaatacagaattggttatcccaaggatcacctgtccgtttccacggtaagccgcctttttcaacacacgctccacattcaccactctcaccatgccaagcggtatctgattttcagaaaaagctcccatagaccattcctttaccagacattccatcgtcttgcatgcaggaatcgtaaagattacctgcacatgatcgctttccattgtttttaccagtgctaaaaatccctgaaggccttccttccctgcataaactaaccgagtgcagacaacaatctgtccctcgttccgcatctctttatggatggtaaaataagctgacggcttcccactgccacggtaatacaggtatgtaaactcctgatccttatacggattagactctgtcacaaacgcatattcataaccttcattgtggatcataccgttatacttcacttcccatgctccgtacaactgctttacatctgaaagcacctgtttccggttggattcatccaccaatacaaaatagccatctttcatatcaaaagaaggaatcatggacaaaagatactgacactgctttccgaaacatccaatctcgaaaccgaatttccgataatacaacattcatctacacaagatcacagcataaattgtgccaccacataattatttaagtccatccctttgtcagtcagataaatcctgccctcacgttttaagagaagttcttcctgttgtaaatgattcaatgcatcaccgtagactgcctcaatcggaatgccaaaagcctgcgtaaactcatcccggtaaaatccatcccgcatgcggagacccaaaaacataaattcctccatctgctcgttccttgtagtctgctctgctgccgcatgcaggtttactgccggaaccagtatgtgcgtgccgtcagcagaagaaaccgcactgcctgtcacaccttctgttaacggatactgcatatagcagtcgtgaatattttcacattctgacagatacgtgtatagatccctcatattggaataccgtacattatcgatcagggaagatgcaccaagtcccacaccgagataatcgacacgtttccagtaaccgatattgtgtctgcactcatatcccggctttgcaaaattggaaacctcataccagtgataaccagcctcttttaaaatgtgctgtgtcatcttcgtggtctggtactcctcctcctccgttggaagggattccgtctgcatgcccgcctcctgcctgactgcatcaaatttataaagatcataaaaaggtgtacctttttctatgatcagcgaatatgccgaaatatgctccggttttaattgcaatacacgatgcagcgaatcacagaaaatttccggtgtctgtcccggcagagaactcataagatcaatgttaatattcgtaaatccatgcttccgtgccatatcataggtctttagaaactgctcgtaagtatgtattctgccaagtattttcaactcgtcattatgtgctgactgtagtccgatgctgagacggttgatccctatcttacggtaaacttcaaatttgtgttccgtaactgtacccggattacactcgatcgtgatctccgcatcccgatccacagtaaaattcttatatacagcttccatgaccgcctgcatagactcttctctcagccaggaaggtgtgccccctccgataaaaattgtcgtaatgcggcgtcccttatacttagctccataaaaaaccagctctttctgcagcgcagcgacatatgacctctgcgtctgttcgtctgcagaaaaagaaaggaaatcacagtaatcacattttttcacacaaaatggaatatgaatatataactccaaaatcttaatcctcgtctaatttcaatacgctcatgaaggcttcctgcgggatctccacgttaccaacctgacgcatacgtttcttaccttccttctgtttctccagaagtttcttcttacgggagatatcaccaccataacacttggcaagtacgtctttacgcattgcttttaccgtctctcgcgcaatgactttgccgccgactgccgcctggattgggatctcaaataagtgtcttgggatctcctctttcagacgctcacacatttttcttccacgctcgtaagcactgtctttgaacacgataaaggaaagtgcatcgacctgctccttattgatgagaatatcgagttttacaagctcagacggctcatatcctttcatctcatagtcaaaagacgcatatcctctcgaacgtgattttaatgcgtcaaagaaatcgtaaatgatctcgttcaacggaagatcgtatttgatgagtgcacgtgtttcctccagatattccatgctgatatagacaccgcgccgctcctgacataacgtcatgattgcaccgacatagtcttttgtcaccatgatttccgcggaaacaatcggctcttccatgtaatcaatttcggacggatccggcaagtttgacggatttgtcaggtcaatgacttcgccgtttgtcttatgcaccttgtatacaacgcccggagccgttgtcacaagatcaaggttaaattccctctccagacgttcctggatgatctctaaatgaagcagtccaaggaaaccgcagcggaatccaaagcccaaagcaagggatgtctcaggctcaaaatacaaagaggcatcgttgatctgtaatttttccagtgcatctctcagatccggatactttgcactgtccgccgggtaaagaccacaataaaccatcggattgacctttttgtatcccggaagtgcctctgcacatgggcggtctgcattcgttactgtatcgcccacgcgggtatcccgcacgttcttaatgctggcgcagatatagccaaccatacctgctgacaattcctcacatggaataaactgaccggcaccaaagtaacctacttccgtcacttcatccatagcccctgttgccatcatcttgatccgatccccgactttgacggttccctccttaatacggcagaatacaattactcccttataagaatcatacaatgcgtcaaaaatcagtgccttcaacggtgctgccggatcccctgtcggtgccgggatcttctccaccacctgctctaatacctgatcaatattcaatcctgtcttggcagagatacggggtgcgtcatgagcctcgatcccgatcacatcctcaatctcctggatcacttcatccggctgtgcgctcggaagatcgatcttattaatgaccggcatgacatcgagatcatggtctaacgccagatacacattggcaagcgtctgtgcctccacgccctgtgctgcatctacaactaaaatagctccgtcacacgctgcaaggcttctggacacctcatagttgaaatccacatgtcccggtgtgtcaatgaggttgaaaatatactcttccccatcttttgccttataaatgatacggactgcctgggatttgatcgtgatcccacgttctctctcaagatccatattgtcaagtacctgtgcctgcatctcacggcttgtgagtgttccggtactctctatgatacgatctgccagcgttgatttaccgtgatcgatatgtgcgataatacaaaaattacgaattctactctgatcaattgccactctttatttctcctgtttcttataaaatagaaaatttctctttcaaagcttttcttttgcctatatatgttaccatactcacattgtttcggcaattattatatgaaatcccggctatactatcttacatttattttgctatacgagcagactcttagtataggcttctttcggatcatgaaaaatatcttctgtctcccctatttcaatcactcttccatccttcataaccatgatacggtcgcacatatgataaaccacattgatatcatgggatataaacaaatatgacaggttcatttcttcctgcagcttctgtaaaagttccatgatctgtgcctgaatggtcacatccagtgcagataccggttcatctgcaatgataaaccccggatttgtgataagcgcctgtgcgatactgatcctctgtctctgtcccccggacaattcggatggcagacgatggaaatacttctcatccattccgacacgggcaagcatgtcataagccgctgccttacggtcagccttagacattgcacactttttatccagaataccggctgccctgagcggttccatcaatagccacccgatcgttttggatggattcaggctgctgtacggatcctgaaaaatcatctgtgggcggctgacatgacagcttacctctcccgacatatgctcctgcattccaaggattgccttggaaagcgacgtctttccgcagccgctctcaccgaccagaccgagactttctccctcatacacatcaaaactgacatgttctaccgcatattgtttttctttctttttgaaaatagaattggatctgtcttcataatatacagacagatcttttactgtaagaaccgttgtattgctctctttctttacggaaaccctcggctttaacctggaaggaactgcctcgatcagatttcttgtgtatgcttccttcggatgcatgaaaatcttctctgtttcatctgcttccaccacaactccgtctttcataacaacgaccttatggcagatacgtcttgccagattcaggtcatgtgtaataaaaagcattgcattctgttcactcttgttgatgtcttttaacaattccacgatctgtgtctggatcgtcacatccaatgccgtcgtaggctcatctgctatgatcagatccggatgcaggatcaccgccatggcgatcatcacccgctgtctcatgcctccggacagctggtgcggataactgtcataaaccttcttcgcatccttaagcccgactgcctgaaaagtttccagtactttttcgtaacgcttctctttctctagatccgtatgaagccttacgatctcatccacctggacaccggctttttttgtcggatttaaggaggtcatcggctcctgaaatatcatggacatccggcttccctgaaatctgcggtacagccgctcatcaaaaggtctgtctgcttctcttaatacttccccatccacgattattttcccggatgtcacctgtgcctgctttgacagaagccccatgagtgtcagtgaggtgattgattttccggatcctgattctccgacaattcctacgatctcaccactgttcacttctatatttacatgcttaacaacttccatgccatcaaaagaaacggacaaatcttctatctgaacaatttttttctgtttgctgtctttttgctgttccactttcatatacttatccccagtctgtcattcattctaccacacagcctctactctgccctgctcccgtcccatttccggataccttcgcccagcagtgaaaatccaagcaccacccatacgatcgcaagtcccgggaaaagtgcataccagggtgctgtctgcaaatatccctgtgcatctgacagcatcatgccaagactggcatccggtgcctgtactccgattccaagatagctcataccagactccgcaaggatcgcattattaaaaccgatcatcactgaaacgagcagcacggaaaaaatattaggtaaaatatgtacgaacagaatacgaagcctgcttactcccatcagccttgctctttttatataatccgcatcacgaagacgtaaaaattctccgcggacaatccgcacaaagcttgggataaatacgattccaagtgcgatgatcacattctgcctgccttttccaagtaaagatatgatcacaagcgtaagcaaaatacttgggaatccgttcaccgcatccgtgatacgcatgaggatctcatctaaaatgcctccgaaatatccggtaaatgctcctaacaaaacacctgccacagttgaaaaaaggacgaccgatgtgctgatcacaagcgttgttcccaatccctgcatcactcttgaaaaaatatcccttccgaaattgtctgttccaaaaatatgatgcatggaaggtgctgtaaatttctctgccgccgacatggcagttgtactgtatggtgtccagaaatatcctaaaatccccaaaaacacagcaagacctgtcataaacaggcctgctgcaagatatccgttccatttttttcttttcttattttccataggtttcacactccgtatcacaagcctatccctgcacaatgccgcctgctcctctgcaaaaggaaacatctgtcctgcggcttttattcactcttacggattctcggatcgatcacccggtaaagaatatccacgataaaataaacaaaaatcaccacgaatgtaatgtacaaaatcaaaatctccacaaccggaaggtctcttgttccgaccgaactgatcagaagcctgccgatcccaggcagtgcaaacacctgttctaccacgatacttcctgccaaaatttctgcgatcatcatgccgagaaatgtaatgaccggcatcatggcattttttaagacatggccgaacatgacctgattcttgctgcagcccttgctgtaagcagtcctcacatagtcaagcttcatctccgtcaacatggaattacgcaaaaagcgtgcagtcatcgctattttcggtaaagcgatcgaaatcgccgggaacagtaaatatgctaaaaatccggtcatattctcctgataacttatgtacccgcccggtacaaaccattttaatacaatgccacacaggtaagtcactaaaattccaagaaaaaatgatggaaccgccatcgtgacctgcgtcaagactccaaagactgcatctaagaacctgcttccacattttgcccacaatacccccaaaggaattgacacaagtacgatcatgacaaatgaaatcactgccagataaagtgtcactggcagcttatctcctatcaattccttcacgggcatcatttcattcatattcttggaataccggtaactcacgccaaaatccccgtgcagtacatcatctgcccaggaaatataccgttctaccggtggtttatccaatccaagctcttctcgaagctgtgcctctctctccggtgttgcctccgttcctaatatggaacgtaccacatctcccggaattacctgaaaagcaaggaaagcagctactgaaacgagaaacaatgtcataatgagagtgcatattttttttattaaaaatttcatgtgtctgctttcctttctgatcagatgataacggcactattttttgtgtccgtcttattttacaaagtaaactgtactcatatcctgtacataaatcggatagaatttgtatcctgcaaggttcttattaaatgctgttgtgttcgccggaacctggataaatgcactggctgcttcctcagcaagaattgtctgaagctttttatagtctgctgccttctctgctgcatcctgtgttgcctgtgtcgctttccagagttcatcatactctgtgctcttgaagttcacaaagttctttttcgaatctgtctggaaacggttcaacagatatcccggtgtcaggtcactgcatgtgataccactgatcgttgcctgatactctctgttggtataaacatcttctaaccaggtattccattctacagcatcaatcgttgcgttgattcccactgcttttaactgttctaccacaacctctgcggtctgcatgtggaactcataaacagatggaactgcgatcgcaagatcaaatccatctgcatatcctgcctctgtaagaagctcttttgccttttccacattggcagaagtaccataaagatcatttaagtcctcatagtaatcctttaatgtaggaagcattgcagagctgatgagcgttccgtttccgccggctacaaactcatttaccatgtctttatccagtgcgtagcagatcgcctgacgtaccttcacatcagaaagcggttcataatcattgtttaagaacaatgcctgcacaacattggatggcgatgaaatcacattaaagctgtcctttaactcgttcgcctgagaatctgtcaggtatgcataaatatcaatgcttccaccctgaagctctaacaatgcagtatctgcacttcccacaattttaaaatctacctcatcaagataaggaagtccttcctgccagtaattctcattctttgcaagaacgattccctcctgcggagtgtaagaaacaaaagaaaacggtcctgttccaaccggattcgcctctgcatcttctccgcttcctgcaggaataattgcagttacaaaactgtagatcagttctgtattcggtgtatccactgtcacctggaccgtcttgtcatctaaaatatccactgcctgaattgtctgtaaagttgctaccaatggtgttccatctaaaagacctgccactctttctaatgagtacttcacgtcctcgcatgtcacatcattaccattatgaaacttcacaccatctctcaatgtaaaagtataaactaatccatcgtctgagatgctgtaatcgcttgctacagcgcaaatcaggttaccgttctcgtctggttttaccaaaccttcgaaaacattaaacagaatctctttagttcctgccgcagttgctttatgtgggtcaagactgtcaatatcctgctgtatgcctacaacaacggagccgccgtatacaggtccttcactgatttctgtctcctgtacattctgctccttagaggaagtatcctccgaagactctcctgtgccatctgcgccacatccgcccagtacagccattgccagaagtgccatgaaaagaatgtgtaatctttttttcataatttgctcttctcctcttcgaattgctttttcctctcattattcaattgcttttttattctatcacacaacatgaaaaaaacaagctgttttgttaattttttgacaattttattttttccatttataaagcatctcatcctgcagtatttcttctgtcggaaccgttggattctggatgttttttaatgttactgttacaactccatctttatcacttgaaaccacatccgttgaaaaacattttcccggagctacagcctgctgtctgttaggatacatcgtccacatctgaataaaattataatccttatcatataacagtatcttagcacacaaatcatcattctcattgcttgtaagtctaagaacagccggacgcctgtttcctgcattatcgataaattcactaatcgtttcgttttcctcatccagacatcccgttacatttatatatccctttgcctcaagttgttctaatgtcacatttttatccagatccaacaattcattccatgctttgtcacctgtcattccccatcctgttttctttaaatagaagaaacatattccaagcatcgccaatgcgatgaggcataatgccacatatattctctttttccccatatatatcctccttagccgctgacaatattgttaaaataaagatttgattccaataagttttttcttcatttcattttcctcttctaaactcgattataatatacctgttctatatatgcaatttattttaattggtttcaccagtaaaatctgaacgaaagtttcaatctcgattcgtacattttttgttcacaataaattcactggattttttgtcgaatctggtgcataatattagttgttgtggcgataccacgacatgggttttattaattataacccccttcttaattttgaaacacccaaacggaatgtctgcatacattccgtttgggtgtttcttttatccatgacaacagaattcgccgagtgcacattctattgtttctgtattcgatttttaagcgtctctaacgttttcctgctttcatctcatccaagatttccgctaccgcctctcgctcgtcaaaatgatattttacacctttgatctcctgataatcttcatgtccttttccgaggagcacgatcatgtctcccggttttgcatttttcatgcagtaagcgattgcttctttcctgtcgtcaatctcgatgtatttgccgttgcttcttgcaagacctactttaatatcattgttaatatcacggatttcctcatcccttggattgtcacaggtcagcacacagagatctgccatctctcctgtcacctcacccatatcatatctgcggagtttggagcggtttccgccacctccataaacacagatcaggcgctttggatgatattccatcaatgtcgtgagaacgcttcttgtgctcacttcattatgtgcatagtcaatgatcagcgtatagtctttggataccggaagcatttccaccctgccttttacctgcactttggaaagtccctctaaaattgcctcgtccgaaattccagccagatgacacactaacatggtcaccatggaattgtataccgaaaatcttcccggaatgtgaactttcgcctgacagtccatgcagccactcactttaaaatgcattccaagctttccatcctcattgataaatccaatatcagatgccataagatctgcttctttttcagcagaaaatgtttttacctcacaggtatgtccttttaaaataccatccacatgttcatcatctgcgttgacaattccaatcctgcactggcggaacaaaaggctcttgcactccatatattcttcaaaagatgcatgctctgccggtccgatatgatccggtgataagttggtaaaaataccataatcaaataaaataccggctgtacggtctaattttaacccctgggaagaaacttccatgaccacatattcgcagccagcctccaccatggcagcaaacatgcggtgtaattcgtaggattccggtgttgtattctttgatggcagatgctcctctccgatcatcgcaccgatggttccgatcagtccgactttttttcctgccatctccaaaacttttttaatcatgtaagtggtggttgtttttccttttgttccggtcagaccgatggtgacaagctttcttgccggatggtcaaacaatgcagcggacatcagcgcaagcgccagacgtgcagaagccacttttaacacggtgatattctccggtatctgtgctgcctcctcttctctctccaatacgatcacagaagctcccttgtcaattgcatccggaatatatttatgaccatctgtcactgctccgaccatgcagacaaacatcgtttccggtgcgatctttctggaatcataaataatatcgcgcacttctgtctcaaggcttccctgaagaagggtatattcaatttcctcacaaatcttacttaatttcattttatcgtttccttttttctttcaacgtatcgtttttcttattttctgatctggctataaaaatactcgtaaaacaattattcttttcgcatacaggtttccgtgatcatcttattttaaaatatgggatgcatcgatctcagcctcaaatacggtatgggatggacctgtcataaaaagatggttcgttttctcatcccactcgatcagaagtggtccgccaatctgttccacggtcaccttgcgatcacattttccggtcagaattgcagtcactaccgcagttgcacagccggttccgcagccaatcgtctcaccggttccgcgctcccactcacggatcttcagataatccctgctcacaaactccgtaaaagtaacattcgttttattagggaaaatggatgtcatatattcaatctcttttccgtatttttccacgtcaagatctgccacagaatcgacaaacattgcacagtgcggatttccccaggaaaccgcagtaatgtgaaaggtgcggtctaatacctgtaccggctgatcgacaaatgtatccatttctgtgttgattgggatcacttttgtagaaagtctcggttccccgatatctgcccggatgttagatacataaccgtctgtcactgtcagtgtcagatgctgcatgccgcccagagtctcgatcacaagctctgtcttatcggtcaatctgtggtcgtacacgtattttccgacactgcgcagtgcatttccgcacatctcgccttccgttccgtccgggttaaacatgcgcatgcggaaatcccctttgtcagatggacagatcaaaaccattccatctgaaccgattgcaaaatgtctgtcactcacgaatcttgcaagttccggcagatttttaagttcctgatgaattgcatctatatatacataatcgtttccaaacgcctgcatttttgtaaatttcatagttttccctctttctgtgtctttttacctatatcctagagacaaatccagggactgccatcttctgacagtccctatccatttcttttatgaattcattgcacggtcaaggtcggcaatgatatcttccacattttcaataccgacagacatacgcaggaagcagtctgtaatgcctaatttttccttgacatccttcggtgtatcctcgtgtgtctgtgtggtcggataagtgatcagtgtctctgttccgccgagactctctgcaaacatgatcatatccacgtttcgaaggattttctgaacggtctcaaaagaatccacggtaaaggagatcatacctccaaagcctctcgtctgtttgatggttgtcgcataatctttgtgatcctcaaatccaacatagtaaactttttttacttttggctgggttcttaaccactccgccactttttttgcattctcgttatgtctgtccatacgaaccggaagtgtcttgattccgcggagtaacaaccagcagtccatcggtgctaactggcttccatgagacttgatatgcacatggatcttctctgcgatctcctcattgtctttcaccacaacgattccggaaagtgtgtcgttatgtccgccaagatattttgtggagctgtgtgttacaatgtcagctcccagttttaatggattctggaaatatggtgttaaaaatgtgttatcaaccaccataagtgccccaacgctttttgcaatctcagataaagcctgaatatctgccactttcatcatcgggttggtcggtgtctcaacgaaaaacatttttgtatttggcttgattgctgccttcactgcgtcaagatcatccatctccacgtaagtgtgctcaatgccgtattttccgaacacgtcaccgataatacggaaggttccgccataaatatcatcagaaagaagaacatggtctcccggattcagcagagaaaatacagccatatttgcagcctgtccgctggaaaatgcaaatgccttgattccaccctcaaggattgccatggtacgctctaactcctgtctggtagggttctccagacggctgtacgcaaagcctgtggactctccaagtgccggatgtctgtaagtcactgcctggaaaatcggcatgctgactgctccggtcaacggttctgttccgagcgccccatgtaccgctttggattcaaaatgtaaattatcttttttgtcataatctgtataattgctgaaattcttcataaaataaatccacctttctgcttgtcatgttcttctgtttttatcttttcctgttttgaaactgcctatgtaaagcctcagaaaatctgtctgccttccatatataagctaattatacaaaacacaatttaaaacatatacaacttctgtgttgtctatattgcaaattgtgctttttttctttataataaatctatcatttgcgatgcaggcttacttacccctgcgaaaaacctgtctgaaatcaaaacaggatattttacaaacggaaaggatatttattatgccagaatataaaaaagtcggctatctgacaacagattttaaaatgtttcatttaaaagacgaggaaatgcgtacctttcactaccactatcacgattttcacaaaattctcattctcttaaacggagatgtgacttactgtatagaaggacgctcttatgacctgaaaaaaaatgatattgtcctagtgcacgccggggaagtacacaaaccggtcattcactccgatgctgtctatgaccgtattattatttacgtttcgccggattttctgaccgcataccgggattcggccagcgatctcagcctgtgttttcaaaaagcttatgaagaaaagtcccatgtactgcgcgttcactccttcggaaacagcagattaggtgccgttaccaaagatctggatgcctccctctcggattctgattttgcacatgaactgcatcataaacttttatttttagagtttctgatccagttaaaccgcgccgccggacacaataaaatagaatttatcgagacttctgcttcgagcgaaaaaatactgtccattttaaattatctgaatgaacacttaacagaatccatcagtattgacgatctctcctcccgtttttacttaagccgctattatctcatgcacacatttaaggaacagaccggctacagcatcggcagttatctctccaccaagcgtctgctgctcgccaaagaactgattttatccgggaaaccgatcacagatgtctgttatgaatgtggatttaagaattattccactttttcccgcgcatacaaaaagtgctttggcgaatccccacgggatctgcgccaaagcactttcaaccactgatcattcctatactgactgccttttggcaatcggttactcattcctgttttcaatgaaagaatcagactttctctgccatcgcattcatcagagtcgggatcaactgcttctttcttgaaatgattccctctaagaggatgccattttcattttcttctctttcaaatgcatctgcaaggatcctgcctgcatcatgcccctcaaaaatcaccctggaagactcttccaaaatatctgtcagcatcacatagaccatgtcgatccgcttctcacccagaacttcttttaagaacggacggagcttctctgctactttatcaagttcttcacggctcatggcgctgatctgtgcaactccgaagtcaaactcatccgtatggaaaatcttgaaatcagaataaaaaatttcctcagtcgtcttatttttgaaatcgcttcccgccttgaacatgttctttgcatgagtctcaatatctacttttgcaatctttgccaaagcctcggcagccagaatgtcaagctgtgtgcaggtcggagaacggaacattaacgtgtctgacagaatcgctgacaataacaatcctgcaatatgctgcgggatctcgatatttttctcaccgaacatctggtaaatgatcgtggacgtacatcccaacggctgatttctgaaatagaccggagagatcgtctctaagcttccgatcctgtgatgatctatgatctctaaaatctccgcttcattgatattatcaactgcctgcgacttctcattatgatccaccagaatgatctgttttttctgcatgctcatcaggttacgtctggataccattccgagatagtttccattttcatccagaatcgggaaatcacggtgtctgatttttgacattgtctctttgacatcatccacataatcatcaatatcaaatgtcacaagatgctctctcgtcataaattctttgattggcatactctgattgatcaatctggcaatggaaaacgtgtcatatggtgttgtgataatcacacagtcttttttattcgccatctgaatgacttccgggtctacctcaaatccacagcctacaatgatacagcttgcattggactctaatgcacgaatctgcacttctttctgcggtccgagaatgaccatatcatccgcttcgatgtattccgataaaaatccaaggtcagacgctccgacaacaacttttccacggataaaatacgcatgttcatttcccgcgataatattgccgtccaaagtctctgcaatattcttatactgggttctcgctttggacaacacccggttgtcataaacatccatgtaagaggttgcaatatcctttgttacgatcacaccctctaactttccaagccggtttgtcaccggaagtgttacgacatctaattttttcatggtttcccatgcttttttcaaagaaatctgcgaactgatgccggctgttttgcggatggaaatatccttgagctgtgcccctacatctgtaattaattctggatcctccaccttaaaataatccagcacataccgggtttcctcactgatcgctccggcacgctttggtacatactggcgctctcccagctggtttttcagatatgcataagaaattgccgcacatatcgaatccgtatccggattcttatgtccgacaacccatactttttttggttcaatattcataaattcctcactaccttaaaaattaaaaacgcctaatgaatataaaataaatgcaaccagcatcacaaaattgataatggaaaaccaggaaagtactttgacatatccctttacagcgccaacgcttttctccatctcatccattttttcaattttagaatcaaactcgttgaacagatcctgaatattgcgatagcattttacattctcggagtgaactttctctgaaagatccgttttgatagaatccagctgggaggttgcattctccagcaatgccttcacttctgcgacctgctcatcgcttactttcttattggctgctgtctgttcttcgataaactgcctgcctgcctcgatctgatcttctccaagctttttgctggctgcgatctgattctcatttaacttgcggtttgcctctaactgttcctcagtcactctcttcacatctgcgacctgctttgagacacttatttcaatctcattcatcttcgcggtgacacgttctgcaagctcgtctacttttttgctgaaatcagatacgatctcatctgcctcttcctgtctctcacttaagatctgctctagttcctgcgctttgtcttctctctcattcacaagattctgcagttcctgtaccttgctctccttggatgtcaataaattctgtaactgttttgctttctccctgaattcatcgatctgacttaataaaaaatcttctttttccactttactatgtatcctttccttagcacgcgtcacttttcctgcgtgttctgttttatcttcttttgcattcagccttgcggacggctgtgtaatttttttcttcttccggtaattctgtgctattctctgaaacagacctgccatttacgtctcctcccacagccagcttaaaataaactatatttattttaccatttgcgctttttcttgtaaaggaaaaaccttcctttacattatgttatcctgtggctgacaatttaaggtatcctgtggatttaaaagaagcggttccagacggaaccgcttctgataagaaagggattatacttatttgcttattttgttatgaatgatattcatacttcaaaattgccgttcattatttacataattttttgaactcatcagctacgaactgtacttttgttccaacaacaacctgaacagctgttttacttggtctgataacgccagctgcaccggcagatttgattttcttctcatctactaaagagctgtcttttacttcaagacgaagtcttgtaatacagttatcaatgcttgtaacgtttgctgcaccaccaacaccttctaagattgttgctgctacagttgtgtaatcgctgcttccaagatcaacttttttctctgcttctacatcatcatcttctctaccaggagtctttaagtcaaactttgtgatagcgaaacggaatacaacgtagaatacgataaatgctgcgattccaagaggaatgatcatccatgtattctttgctgccggaagcggtgcagagaagattaagtcagttgctccggcggagaaactgaatcctgctctgaatccaactaatacagtaataactgtgaagataccatataatgctgcatatacaacgtaaagagctggtgcaaggaacatgaaaccaaactcgaatggctctgtaacaccacaaacgaatgcacaaagagctgcggaagctacaagtccgattgctaatttcttcttgtcactcttagctgtgtgaaccatagcaagagctgcacccgggacaccgaacatcatacatgggaagaatccagacatatacatacctaaatcccatgatacatcagcagatgtctcacctgcccagaagtgctgcagatctccaagtccgatcgtatcgaaccagaatacgttgtttaatgcatggtgtaatccggttggaatcagtaatctgtttaagaatgcataaatacctgcaccaacaggtccaagtccaacaatactttcaccaattgcaactaatgcaccaaataataatggccagataaataacaggattgctgaaacaataatagaaacaacacctgcaacgattgctacgcaacgtttaccactgaagaatgataaccagtcaggtaattttgtacctttgaatttgttgtagcatgttgcaccgataatacctgcaaggataccgataaatgggtttgcaattttaccaaatgcaagagattttgttgcattgtcagcgattgctggcattaatgttgtaactgttcctacggaaagaaggtttgtcatcattaaccatgatgctaatgctgcaagacctgctgtaccatcattgtcgtctgccattccgacaccgacaccgataacaaaaagaattgccatgttatcaattaaagctccacctgcttttacaaggaagaaaccgatcatctcaagtataccggtaacatcaccaccctgcatggtagatggacaaagcgcatatccaatacccattaagataccacagattggaagacacgcaactggaagcattaaagcttttcctaatttctgcaaatacttcatcatactaaaagctcctcctttttttataatcccttttagttttattttataccgttagaaacacggctaaaatacgtttttcatatcacagatccctgtctgtttatttctttaagatcagaactgtatcacccggattgacatcagatcctgtcactgcttccacggtctgatagtccgatgtgttgcatacaaccataggtgtgatcacatcataacctgctgctttcactgcctcaaggtcaaccgagatcagaagatctccttttttcaccgcatccccatttcctttatgggcggtaaaatgttctccctttaatgcgacagtgtctaatccgatatgcacaagcaattccacgccttctgtggtcgtcatgctcactgcatgcttcgtatcaaataacatctcgatcgtgccgtctgccggtgcgtatatcttaccatctgccggctggattgcaacacccttgcctaagatctcttctccgaatgtcggatcacttacctgactgattggaactgcctttcctttgaccggtgcaccaatctcaattcctttgtcttttttcttcaaaaaatcgaacaccttaatccctcttttctgtattatgatgtactttagtctgtcatgcagacacgcttaatatgtatcgcaagaaacatgatctcctcgccggatatctgaccgccgtactctttttcaatatattctgcaatatgtttactgcactcatactctcccggatacttgttctccatcagctttgcaaattcgatctcctcatctttcaacaactcatgccggtaaagacgctgtgccaaaaacttcagatgtgtgacaaatctctcatagtggagcgattcctcatcaaattcaatgcccatctcctgtttgaccagttctaagatcccctgtatcatattcgtcattgcaaaggtatcgttgatcgttgtatcgtactctgcattcacaaaatggagtgcgataaatcccgcctcatcctctgaaaactttgttccgagtttttcattcaaaagattgatcgcatattttcccatcaggtattcctgatgataaaacttcttgatttcccacagcagtgcattcttcagctggattccctgcacctgtctctgaatcgcaaaattgatatgatctgtcagtgtgatataaatactctgattcaactgtacattcagattctttttcgcataggtaatgatatcactcgtgagctgcatatgctctaatggaatgttctctaaaatctcctgaaactgccgggaaagcttctcgttctcaatccggaaaaccttctcgaccctgctctcatcaatcgcatcacccgtatgtgccttgaatccaatccccttacccatgataacaacttcctgctgattctcatcatatgctgatattacgttgttattaatcactttctggataaccatatgccactccgtttttatttgataaaagcctctgttttactgtgcattctaaaaagaaaaaccaaattttacaaaatccaagtatagaaatgtaaaatctggttttgcctgcttatcagtaacaatccaatattttattcgcttgatttaagaaaattttaacattcattgtttattatgtcaagttttattcctgcttatttttcttttttgtaagcatttactatatatgcatctaaaacctatacataatagccaatatcttttccatcttctaccggagttttacagattcgtttcaaagaacgcttttattgcatcacatgctgcaccttcgtcgtcgccttctacctttacagtcacagtctgattttttttgactcccattcccataactgccatcagtcgggaagcatctacagattttccatctttttcaagtgttactttgctctggaaatttttcacttcctttacaagcatccctgccggtcttgcatggattcccaactcgtcttttactgtgtaactgaatgatttcattttcatttcctccttaaacattaagcatttaatattttatctcttacaggcagcaccattgccggtgataccgataattcatcaattcccatttttacaaatgtctccgtaagcgttaagtctgccccgagttccccacagatacctgcccagattcccgctttgtgtgcgctgtcaatgaccatctggatcatcttgagcactgctggatgatgggagtcataaaactggtcaagctttgcattctgcctgtcgatcgcgagcgtatactgtgtcaggtcgttggttccaatactgaaaaagtcaacctcttttgccagttcatctgcgatcatcaccgctgccggtgtctcgatcataatgccaaattccacatttttaaacggaatgccttctgaggtcagctctgcttttacctcttccataatctctttgacttttctcacttcccataccgatgcgatcatcgggatcataatggaaatattgccgaacatgctggcgcggagcagtgctctcaactgtgtcttgaaaatatccggctgatccagacagatcctcacggcacggtaaccaagcgccggattgtcctcgtgttcgagtccaaagtaatcgatctgcttgtctgctccaatatccagagtacggataatgactttttttcctgccatcacttccgcaaccgttttataggactggaactgctcatcctctgttgggaaatggtcactctgcaaatataaaaactcacttctgaaaagtccgatacctgctgcatcattctgtaaaacagcgcctaaatctttcacttcgccgatattggcatacaattttatttctttgccctctttcgtgacggtcggctttccctttaattgctgcagtaattcctgacggttcttttcgtcctgctgctttttctcatattctcttaatgtctcctcatccggatcaatgatcacgatccccttgaatccgtccacgatcgccatttttccattcacttctttcggaactgctgtggataccagagccggaatgttcatcgtcctcgccaggattgcggtatgtgaattcgtagagccatgtcgtgtcacaaaggcaagcactgtctcacggtctaactggatcgtctcactcggtgcaagatcatctgctgctatgatatatttttctttttctgctccagaagtgttcaccttttcttctttctgcgataaaacacggatcacacgctccgagatgtccttcacatctgctgcacgttccttcatataatcgtcgtccatatctgcgaacattctggcaaagttatcgccagtcgttgccacggcgaactctgcgttgacggactgtgcctcgatgatattccggacagaatcaagatagtcttcatcctccaacatcatctggtgcacttcaaaaatggctgcatttgcctctcctacttctttgaccgctttgtcataaagtcctttcagttcttctgccgcctgatctctggctgcctcaaaacgtgcgatctctgctttcgcatcctcaatcttcactcgtctgactacattgttttctttggaaatctctttgatttttccgattgcgattcccccgaatgcaatctttccggttatgttctgcatttgctcctcctcaccagacagctgataccattttgggaatctgccgtcaaaattaaaaaagccgaaaaagttcacgcagccaacggcgtcttacttttccggtttagtacatttgcatgtgaactatccttaaaatataattttattataagttttcacaaagtatttgtcaacacaattctgccagtctgtgtacttttgctgcatccaccacttcatattgattcttttcctgtattcctgcataggagaaatcaacgtattcattcgaagttgtgatgtcttttttccatacccggcatgaactgtgtacctgatgaactcctgtatatgtcattagttctctaacattgttctcattcacaccgcttccggcaagaatttcaatctcacttccatattccttctgaagctgttttaaccgttctcttccactccacacatccggtgcgccgccgctcgttaagattcggtctgccccaagcccaatcaattgctcgatcgttttcttctgatcggcaacacagtcaaaagcgcggtgaaacaccgcttcccttccctgctcatgtatcagatagatgacttcttttgtacgttctgtatctaaggtttgatcctcttttaaaaatccgaaagcaatcccgtctgctccatgctccagcaaaagttttgtatccaaaatcattgtctgatattcctccgcagaataacagaatccaccacctctcggacgtaccatcgccacaacaggaatctcacactgttccttcgcgcagatcagatttgccagtgatggggtaagaccgccaagatataatgcactgtttaattctaccctgtcggcaccattttcatatgctgtttttacatcttcaaaactgccgcagcagatttctaaaactgatttcataggtttgtcacaattccttttcttatcattcggattgatgattgttattataaactttctatcttttaaaatctactatctacaaaaaatctttttttcattttctctataaacaataaaatgaatgttccgcgaacattctattgtcctgaatgcagaaagcctggaaaggcttacgcctttccgggctttctggaatttacaatgactcagacaatgtccaaatcttatttgtataactcaactaatcttaacagatgttcgtaacgagcttttgcagcttcctcagatgcagcaaagagttttgcagctctttctgggaaggatcttgttaatctgctgtaacgtgtctcgttatttaagaactcctgatatgttccatcgcctggtttagatgttaatgtgaatggattctttccttcagctttcagagctgggttgaaggagaagaggttccagtaaccagcagctactgctttcttcatctcatcctggcagtggttcattccacctttcacaccgtgtaactcacatggagcatatccgatgatcagggatggtccgtcataagcttctgcttctgcaagaactttaacagcctgagccatgttagcaccaagagcgatctgtgctacataaacgtaaccatagctcatagcgatctcagcaaggctcttcttgccaacttctttaccagcagcagcgaactgacaaacttcaccgatgttggaagctttagaagcctgtccacctgtattagagtacatctctgtatcgaataccataacgtttacgttatgtccggaagcaagtacatggtctaatccaccgaaaccgatatcatatgcccatccgtcaccaccgaagatccatacggacttcttagcaaggtaatcttttttctcaagagcagcttttgcatctggacatccagctgctgcagctttctctaattcagctacaagagcttctgttgcaggagtatttgcttttgtatcctgttttgtctccatgaatttagcgaatgcatcttttaattctgcacttgccttatcagaagaagcacatttctcagcgcttgcgatagcctgatcacgtaatacttcctgaccgatctgcatacctaaaccatgctcagcgttatcctcgaataaggagttagcccaagctggtcctttgttggaatctttatttacagtatatggtgatgtagcagccgggccaccccagatagaagaacatccggtagcgttagagatgtacatatgctcaccaaataactgtgtgatcaaacgagcgtaagatgtttcagcacatcctgcacaagatccggagaactcaagtaatggctggttgaactgagaaccttttacagtattgtcagctggcataccaggtttcttgccaacgtttgctactaagtagtcaaatactggctgttcttctgcctgagattcctgtggaaccatctcgatagcacctactggacatacagtgatacactcaccacatcccatacagtctaatggagatacgctcattgtatatttgtattcgcttgcttttggttttgtatcagcaagtttgatgttagccggagcagcttttacttcgtcttcacttaacatgaatggacggatcgtagcatgtgaacatacaaatgcacactggttacactggatacatttagcagcatcccatgtaggaactgttacagctgtaccacgtttctcatatgcagatgcaccctgctcaaactgtccgtctgggttgcccatgaatgcagatactggaagagaatcaccatccattaatgcgattggattcattaaatcttctaccatcttaactgtctctggacgacctgttaatttagctggagctggatctgcttctgggttagaccaggaagctggaacttctactttatgtacagcatctacaccagcatcgattgctttgtagttcatctctacgactgcatcaccttttttaccgtaagatttcttagcagctgctttcatgaaatcaacagcttcgtcgattggcattacgttagcaagtttgaagaatgcagactgaagaattgtattagtacgtttacccataccaatttcaattgctttgtcaatagcgttgattgtatataactgaatgttgttatcagcgatatatttcttagcttctgcatttaagtgatgagctaactcttcatctgaccactggcagttgatcatgaatactccgcctggtttcacgtcctgaaccatcttgaatccttttgttacataagatgggttgtgacatgcaacgaagtctgcctggttgatgtagtatgggcttctgattggtttgtcaccaaatcttaagtgggaaattgtaacaccacctgttttcttggagtcatactggaagtaagcctggatgtatttgtctgtgtggtcaccgatgatctttgtagagttcttgttagcacctacagtaccgtcaccaccaagtccccagaacttgcactctacagttccttcagcagctgtgataggagctggttttacttctggtaagcttaagtttgtaacgtcatctacgataccaattgtgaaacgtgcttttggagcatctttctctaattctttgtatacagcgaataagcttgaaggtggtgtatctttggaacctaatccgtaacgtccgcctgttaatacgattgtatcaagacctgcctcacgaagagttgttgctacgtctaagtataatggatcaccaagcgctcctggctcttttgttctgtcaagtactgcaactttcttaactgtctttggaagaacttttaagaatgcttcagatacccatggacggtataaacgaactttaactaatccgactttctcgcccttagctgttaagtagtcgattacttcttctgctacgtcatttacagaacccatagctacgataacgcgctctgcatcttctgctccgtagtagttgaataagtcgtagtttgttcctaatttttcattaaccttagccatgtatttttcaacgatagctggtaattcattgtaagctgtattacaagcttcacgatgctggaagaaaacgtcaccattctcatgagatccacgcatagctggatgctctggatttaatgcatgtgcacggaatgcagctactgcgtccatattgcacatttctttcagatctgcataatcccatttctcgattttctgaatttcgtgggatgtacggaatccgtcaaagaagttgatgaatggaacttttccttcgattgttgctaaatgagcaaccgggcttaagtccataacttcctgtgggtttgtctcacataacatagcgaaacctgtctgacggcaggcatatacgtcactgtgatcaccgaaaatatttaaagactgtgttgcaacggtacgtgcagaaacatcaaatacacatggaagctgctcaccagcgattttgtacatgttagggatcattaataaaagaccctgggaagctgtaaatgttgttgttaatgcacctgcagcaagggaaccgtgaactgcacctgcagcacctgcttcggattccatttctactactttgacctgattgccaaagatattttcctgtcctgctgctgaccactgatcgacagtatctgccatagggctggatggtgtaattgggtaaatagctgcaacatctgtaaacgcataagctacatgagctgctgctgtattaccgtccattgactgttttgctctggacattacttattcctccttaaaaatataaaaaattgatagaatgtctttgctaacccgggggcacactgctatcccccgccagctttcgacttaattcacattttagcatttaatttgtccgttgtaaagaattcagactgtacaaaacaaagtacaaagttataaacgttactgctcacccggcagtaaaacacttgccaaaagcacagatttataaatattttctttcaaattcatctgccgggatcggccggtcaaacagatacccctgcccatattcaaacccatggctttccaagaactgacgctgttcttccgtctcaattccctccacaacgatctcttctttggctgcacggataaattttcccatctgggatacaaattcccccttgttgtccaccatcactttgtcggtaaaacttttatctatcttgacaacattcgccggtatttcataaaggacactcaaagacgaataccccgtaccaaagtcatcaatggcaatgcggaatcccatctgtgccagttcgatcatgcagtgcttcaggtcttcgagtttttctgtcatgacgctctcggtaacttccacttcaatataggaaggatcaatgtcatacttgtccattgtctcatgcatccgctgcaaaaatgcctcgccaccgttttcaaagtgttttctcgaaaaattagttgagatcgtaaacaggctttttccggatttcttccactttgtcatatatttcagcagctgctctaatataaagaaatcaaggtctttgatatatcccatcaattccagtgccggcacaaagcggtttggctgtaagtatccgtcctctccgaaatgccatcttgcaagtgcctctgccccataaatcgtattctctttcagccggaactttggctgtaaaaacatttcaaactccccacgctggatcgcagcatgaaaccgtgttgcgatcagcacctgttcgtcacgtgtctgacgcattttttctatatagacaacaccggatgtgatattgtgttcttttgcatattttcttgcaagatttgcgctctccagtatcgtctcaaacgaactctttcctgacaggaagcagattcctgccgaaagcttcattcctccagcgggataacgttcctgcagctttgcctcaaactcttcatttccttccttaacgcgcctccggatctcctgctggctctttcccctggacaatacaaggaaataatccgagtacatacggcatgctgccattacttttttgcgttccagcagccgggaaaattctttcagtatactgtctcccatctctgcgccgaaattttcgttgacataagaaaagttattgacatccaccatggtcagtgcataagtattctcctgtggattttcctctgcctccagaagctgtaccagttttatcctgaaagcttccatattatataagcccgtcagccggtctctgttttttaatttatggattgcctgctgatcttcctgcattttctcacgcagcgtcacaaatacggcaaccactctgctcagttcgcagatagttccaatctcctctgtgcgccactgcttgccctgttcaaccgagccaacatcgatgcatccggtttttccattcgaatactcaaactttactgcagcgattgactggatcgggatggcatttcctgaccattccagccactctttcttccgtttttcctgccactttggagttgtctgtacaaattctcccacctcagccttcatcagtttcggccaggtaatcggaagtatattcttctcataaatctgtcccatgtcactccagcagttggtaagtagcatattctttccatcgggtgcatattcaaaaacagataccatattcatctgatattttctgccaatctgttctaagagcacattcagagaaccattgatatcccttgcatgtgacaacaggctgaacgctgtatttaaaaattctttgtccgccaccagatttctacggttttccttttcttccgtgcggtactttccttcacagtcaccttcctcggtctctcctgcaaagccataatgatttttcccatttttcttaatgtgatacatggcatgatctgcccgttcaaacaacgtactataatcatacccgtcttttcctgtcacagccataccgacactcaatgtcacaacaatgactgctccatccccggaaagcgttttctgcacgtttgtacacagctgttccgctttcgcctccgcctcctgcaaagaagtgtccttcacaaagaccataaattcatccccaccgacacgtccgacaaccgcttcatccgtaaactgttcgcgtatcagtgttgcaatatccgatatcaccatgtctccaacagtatgtccgaatgtgtcattgatcttcttaaagtcgtcaatatcaatgacgtagagtacatgcgttccctgtgttgatttttcaagaaacgcatctacgatttctccggaggctgtcttattgtaaatccttgtcaacggatctaactgcacttcccgtagaagtttctcccggactgcccgctctgtgctgatatcataacttcttcctatgatgtggctgatctttccatcataatctgcgatactctgataacaggttctgaaataagcatattttccagattcttttcccccctgccgcagacggtattccgcagttcctttcatctcccgttgaagcgccgtctcaaagatcttctgaaatctttccctgtcgtccgggtgtatggctccgtaaagttcttctatcccggcatatttcacacttttatcctctgcgaatttcagataacattccggtatctcaaattgctgttttttcacatcataatcaaggacaatatcatcggagacctcttccagcatatgatagcgctcgttcacaagcatgatctcattttccatcttcttgcgctctgtaatgtcccagcaggatacaagatagtatggcactgcactccggtatgtgtaaatctgaaactgaaacattgcccagatcacgttctgatctgctgtaacgattctcgcctcaaattcatccgatgttttccctctgcggcagacctccgccgcatcctcaaacatcatgtaatcttccatatggatcaactgcgccatgctcattttttccatgctgaagtccgccaattcgtatccgctcatcctgcaaaattcatggtttgcgatgtcaatcgtcagctcatttcccccttttaccgtaatcagtcctaccggaagttcatatataatatttttcaaatctttgcgctcacgctccgactgccttagctgatcttcataatctatttcttccctattaaattctgccatccccaacttctccttttacaaaaccccgattagaataattataacaaatttttacataacaagaaagattttctcttgttttttccttatattttcttggcatagatttttcttgaaaaaacaacggttttatgtataataaaaatgatgcgtttaaaccaagaaatatgtaaaatagaggtattacaatgatacaagcaaacaatgtaacgttacgtgtaggcaaaaaagccttattcgaagatgtaaatatcaaattcactgaaggaaactgttatggtctgattggtgccaacggcgccggaaagtccacatttttaaaaattttatccggtcagttagaaccgacaaacggtgatgttgtcatcactccgggacagcgtctctcatttttacagcaggatcactttaaatatgatgcttttaccgttcttgataccgttatcatgggtaaccagagactttatgatattatgaaggaaaaagacgccatctacatgaaagaagatttttccgatgaagatggtatccgtgccagcgaattagaaggcgaatttgctgagatggatggctggaatgcggaatccgatgccgcaacattattaaatggtcttggaatttctaccgattaccattactctatgatggcagagcttcctggtgccttaaaggtcaaagttttacttgcacaggcattgttcggaaatccggatattcttcttttagatgagcctaccaaccacttggacttagatgcgatctcctggttagaagaattcctcatcaattttgaaaatacggtgatcgttgtttcccatgaccgttacttcttaaataaagtatgtaccaatattgcagatatcgattatggcaagatccagctttatgccggaaactacgacttctggtatgaatccagccagttacttgtaaaacagatgaaagaagccaacaagaagaaggaagaaaagattaaagagttacaggaatttatttcacgtttctctgcaaacgcttccaaatccaaacaggcgacttccagaaaacgtgctcttgaaaagatccagctcgatgagatccgtccatccagccgtaaatacccttacattgacttccgtccaagccgtgagattggaaatgaagttcttactgtggaaggtctcaccaagacgattgacggtgtcaaggtattagacaatgtatctttcatcgtaggtcatgaagataaaatcgcttttgtcggtggaaatgagcttgcaaaaacaactttattcaagatcatctccggtgaaatggaacctgattccggctcttataaatggggcgtgacaacaagccagtcctatttcccgaaggacaacacagcaatctttgataccgatcttctgatcgtagactggctgacacagtattctgagatcaaagatgctacttatgttcgtggtttccttggacgtatgctttttgccggtgaagacggaactaagaaaatgcgtgttctttccggtggtgagaaagtccgcgtgcttctctcccgcatgatgatccaggcaagtaatgttctgatccttgacgaaccgaccgaccaccttgacatggaatctatcacagcattaaataatggtctgatcaagttcccgggtgttattctctttgcatcccgtgaccatcaggttgtacagacaactgcaaaccgtatcatcgagttcttaccggatggaacctttgttgataaagtatcctcctatgatgaataccttgaaaatgatgagatggctcgtaaacgtcaggtttacagcatgtctgatgatgatgcttctgataactaatattgttttttatcggaaccgcaggttatcccactctgatctgacctgatccttctcatctttctcaggcggatcagagactacccagactttcttaccgagaaatccaaagccgagtttatagatgtgatcggcagggatgccgtaggcaagaagatctgattcatagtttctggtccggatctgtttcagggcattctgtgcagtttcctgaacagtcttttctctgtgttcatttaaaactttaaattcaaggatataggcatcttttgttttgtcgaaaggatagattgcaatgtcataacgtccatccccgctctcccggttggatacaatgcggtattccttacgcatggatacaataagtcctaaaacaagaccatgatagaaattctcgggagcatgctttcctttattctttgcggtatcaaaataactcatggaatactcggcgatatcttccatcacaccgatcatatcccaggttctatgccttattagtgcccttgtaaaattctcatatgcaatgttgccattcgaaaacatggcaacgatctgtgtccggaacattgacataacctctttgttggtcacggaaacatcacactctgtccattcgttatctttcaccacgttctctgccttgatatatccaactgcaaggagaagtgaccacaggctgttctcatctccgtcaaggtactggaacgtaatgttctcgttgatcactttgtgtattggttttcctgtcattaactgttcaatctcgtactttttatcatacggatgcctgcagataatatccccgatcagtttgttactgctggtaaggatccaataagatcttaacaatcgctccttcatgtaattcacgattgaccacggattataaatatctttctgatgaccgataatgaatccatcgtacatttccttcacttttttcatgtcatctatattctggcactttagtgcatccatcacctcctgctcggtgaatccacagcagtccgtgtaaatatcatctgtcacagtggcgaccagcagattgttcaggtcataaaaaagtgaattcttcaacacttttgttactccggtgataatggctctgccaagatagtcattttctttcagtgtattatggaataactgccggcatgtcgtgatcatctcatcccagtaaccatccgtatatgcctcgatcaaaggtgtgtcatactcatcaatgagaacaatcggttttacaccaaaatgtttatagagtagttcgcataaatatcttatggaattctctatatagcttgtatcattattgaaaaatgcgcactttgtttctttaaataattctttgtctctatccgagagtctgggactgtcgagtaaatattcatgatgtccatacattgttctcaattgtcccatcattccccggatagactgcttataatctatccccttgcagcctccgaagcttgtagagatcaccggagtgcttccgaacatactgcggcttctttcgtcctgccatacccgaagcttacaaaaatattccggatgatcagcatatcttggatcaaaaaacattcttaccgtactgagcagggttgtcttaccaaatcttctcggtctggtgatcaatgtgatcttcgttccttccctgagccactcggtgataaaatgcgtcttatctacataaaactgctgtccacaggtaaagtcttcaaaatcctgatacccgatcaccaccttggcagagagatatggattgtgcttaagaatgtccttcagtccctccgcataagccgtcagatgccttttctcttccaacagctttgtgcgctcctcaaattccatgaacacctgctcccgctcagacactttcacataatagctcactgattttccgtcaatcgtccgctggatatatggctgctctttgccattgatcttcttataggtcagggttccttttggaagttcttccagtctccggtcaatctcttcaattcgtttcgttggatttgtggacataacgcactcccttctgtatataaaagtggttatcattggttatatacacatcatataaccaatggtaaccacttgtcaatcttcttttaatattttccgaagcatcggttcctcgtccaactgcacattttcgaattttttgtaaaatctgtcggcattctcgttggtagcacggatcagataatattgatggatttcatgcttttcgcagtctttttcaaactctgcaaacagcttccgggcaacgccgctgtgccggtattcgggtaaaacatatacccaattcacatacgccatgcgatatccatcctgtatacacccataaaaatgatactcaattcttcctgccacctgattattttccatcgcaagaattgatgcagacttttcataaaatgaatcccgaagccttgtcctgattccttcctcatccatctcttccaccgtcatcatatccggctcctgctgcatcgcaagctttaaatagtcaatatactgctctacattctgttcattcaatcttccaaaatacatttccttccttctttctaatacctgtaaatatggttctccaaaacatacgtttcacctgttcttggatctgtcttttcttctgacagtgaatcgaatacaaatccacatgacagctgtaacactctggacgcagcattgcctatacggttgcaggcatggaattcttttgctcccagttttcccgcctcctcaagaagtgtcgtaagtatctgtcgcccatatcctttttgcacaaattccggtccaagtgcaatgcctgtctcttcataaatacccggctctaactcacgcatacctgcaaaaccgattgcttcacccgttttctttaaatacacaaataacgcatacttattctccggtttttcttcaaatgcaatcgtgcgcttcattcgatcttttgcatcttcgtctgtctctgtcggctgccagagcatatactttgcgctctccttgtgtctccacaggttataataaattgtcttccagtcctcaaattctgctttctttaaaataagatcttttgtttctaattttacgtcaaagtaatctgttaccattttttctcttatacctcctctctcattatttttctatgcattggtttctcgtccaactgcacattttcttccacccttatcaactttgcaatatactctgtcgtgccttcttccaattctttttctccattttccataaatccgtgacgatgataaaatgcaatcgctctcgtatttttctccaacgcccacaaatgatcaacatcaaaagttgaaattgcatgccctattaatttctttccaattccaccactttgaaagcatggatcgacatacaatttacggatttctgttccatggatttccataaatcctttcacaattccacattcatcggcgacatacagattttccagaacttccccttttccgaaataatgatctatcatggatacaacctgcaattctccaaatgaatactcttcctgcttaaaaattgggaaataattgattctgttattaaatacaaaaatttctgcgatgcgcgacaaatcttcttctgttgcttttctgatcatctccggatacccctgtcattttcttttatctgaaatcaatataacacactttccgccaaaatactttctaaaaatcttttttaattttccttttccaacaacctttgataggctgcatccatcccgattgccccaagcggtgctgtgatgatgattgcaagcacagcgacagacagaacaatttttccacaggcaagtcctgccgccaaaggaacagaaccaattgccgcctgcaccgttgcctttgggcgataagcgatcacacaagccattgcaaccaccgcaagcagtcctgataaggaaatttttccttccagccatccttccactgataccagtaaaaaggaaaatccaagaacaatgattacttttatactgttacgcacgcagtgttttctcgcatatgccgtctcaaagaaaagatacagtccataacctgtcactgcgcctaaaattataccaagtacgattgacaccggaatatttacaaaatcaagtacattggcatgaccaccctgctcaaagcacataacctgcaatttcaagcgatgcaggaacaaacgacagtaatacagcggaacgcccggcttttttcagatcttttaaatccagtgaaagtccggctttcaataaaataataatcagtgccatcttccgcagctcagcggagattgataaaatggatggatcaagcaaatcgagcacatacggtcccaacacaattccggtgacgagtattccgatgatccgtggcagcttcagtttctggcaaatggctcccattgcaagccctacaataaaaataagtgataatgatgctaacataaatcctccatttctgtttttggatatgtcaatcgccatatttgctgtgcggatactgactgtatcgaaaactgcaaatcacactgtagttattctacctcaaataccacaatccgctctcttttattttcccccggaaacaaatctctgcaatcgatttcatcggaaaagataagttcgtctactgtcattaaataagaaatgtattcatccgaaggataataaaagaataaaagcaattccctcggattctcataataggattccaacacgcgcgccaaaactttctttaatatctctatcgaaaatggattaaaaaagtagatccggtctacctctgccggaaccgaaaactgcacggcatctgcaagtacaaattctgtccgccctgccgcaaccccctgttctctgttttctaccgctttctcataaatccgctcgttgtattccacaccgatcgtgtgacagcgtgtctgataagaaagaaaaaaatcagctctgcctttgccacagccataatctaaaagtgtattttccctgcaaagcagcccggaattagcaaaccgctctaacaccgtatatggcgtcggttcatacggatatcggtactgatctgaattggaatcatcacgtccggttgtgtgaatctgtagtaatttatcccatttctgttcttcatcgtttcctgagattttttcatgttctctttccacaactctccgaatataaatttcttttagccccatgaatctgcccttatcagttccagtacagcgttcaaaaattaactgaatcaataacgcagatggaaattcatacaagttattagctcagttatttacagaacgatgtactagtcttagcagttttcacgcagtgttttcagataaactttctgctcatctgtgatgcgatagctctccaccgctttctgaatcgtctttctatgcacccacggtgataactttcgttcttccagatatgggatcgttgcatcccactgttttgccagtgccgttgcaagataccatgcaatcatcatattgacatagtattcttccgattctacttctgcggcaatttctatatactccggtttgaaatcctcatccagataaaagctcatcagtgttccgattccatagcggattgtataggtatccccggatgcaatccattcttttatcacaggaagaagttcagctttgttttttgcgaaacactttggtcttggaatatcgcaggtcgcccagttattaatatatggaagaaaacgtttcacttctgccagacagcgctcataatctttgatatctgaaatcaaaagcatatgaaggttattttcctcataatactgatgtggaagttcctttaaaaatgcttctgctgcttccgtttttgcaaattctttcgcaaatttccgcagtaccggtgtgcggatcccgatgatcgtctccttatcaatccccggcatcagtttactgtgaaaatttctgtattttaaatcctgtaattcgaataatttgcgctgtaagctgttcatgtttttttctttcacttttatatttcttccactttacaatcatgctcttttgtttctttgttataactgattccaaccacaaggatacgccctgtatatttatttttttctgccgtttttcctctgaaccgcaaagcatagtctttttctttaatctgtgcaattgcatcttctggtgaatgatctacttttaattctagtatgatacaatcctgatcatatcgaaccggataaaatataaaatctacaaatccttttccagccttctcctcacgttcaactctgtactgatctcttgcagacaaataaacaagattgacaattgccgaaagttctgtctcattattataagacaaaatcggcacttctgtattatgagcatactgaatgatttttgtcattgtctctgtatctttggctagtgttgcctgtagcatctgtgatgatatgttggcaagacgataaatatatcctaacgattgttcttttttcatcattgctgcataacttcccaaaagttccttatttggtataaatacttttccattatcatacgtcagcaaaccatatactaccattgcagaatatatctcctctttggtctttagttctggtgctgttgcagcatattcctgtatccctgttggtattttttctcctgcaaacattaaagtaagatcgttctggatttcatctacgttatgactgatatatgtgaaaatagagtcatattttcctgaactcacccaataatttgacaattgattatctgtcaatgcgcatactaccgaacgtggattgtataatctttctcctgatgcagtgtgatatccatcataccattccctgagatttgcgcgtgtaatctgtggcttttttgtttgctccagatagcactggtacaatctgtcaacttcactctctgtaaagccaaaatattcactaaaccgaactcttgttgccatattgtattccaaaaacatattcagttctgaaccatctgaatattttgcaatcggaagtacaccggtcatatatgccagttctacatagcttttccctttcaataaaagtttcagaaaaagcagataattttctctgtcacgttccgtaacaaaagacatctggaaaactgcgtcccattcatccatcacaaatatgaatttatgtcctgttttgtcaaaaacctgagaaagcacatcccagaccgcctcatttttgtctatcgcaatctccggatatgcctcgttaatatctctgacaagtccatcctgtattctgccaatatactcctcataactatgacattctcttggcatttcactaaaatcaatatatatcacatcatggcagcctgcctgctccttatattgatcatattgtgcgattgcaagcttctcaaataaagatttttcactatttttttcaaaaaaagctgctatcatatttgccataactgtttttccgaaacgtcgcggacgggtaatacaaaaaaaacgctgttcctgctgtaatgctggaattaattcttttaatatttctgtcttatcaacaaaaaaggttccattcattacggtcttgtatttatcatatggttccttattatttaaaaactgtcccattctactcgccccccttagcctgatactatgagtatatctttttttccaaatgggtgcaagaatcatctgttaattcctgttaaaactccttcttctccataatacgcctgctgatctggtacgaaacaaacagtgccagcagtgtgatcccaatgatgttaccagccagaactgccacattcatattgtctatcacggtcagcgcctgatacaaccgttcttttccgaacacgacctcacatagatatgcaatcgcagcaattactcccatcattcctaatgtcaaaatccggctcttttcacagccaaacttaatctgcgccggaatcatgaaaaaactgatcaaaagaatgattagcaaaatcactgcggctgtcagcatatcttctgccacaacaaccggtataccacgcaccacttttgacaccagatacaggcagactgcaattacccaggctgccactactcctccggcacaaagcagatacttttctcttacatagttttttttattgatcggcagtgtcaataaaaactgatagccatgatccatctcgtcatacgcaatcgtgctgattgcaatcatctctaccacaaacggcagatatccaatgataaaatttccgttgccggaaaatgtgactgcaactgcaattgcaaacaaaattaccagtgtctgttttgttccccataataaccgaatatctttttccaataaacctgccattatctgtaccctcctgtcatcataagaatcagctcatcaatccctccattttccactgcaatctgcggataattttcctgataaaacttcttatcattcgtaaaacatgcatagccgtaattttctttctgcacttttaaaatagagctttgatcaagcgtgcggtattgttcttcactcacctttaaaatgccatactgctctaagattgcatctgttgcttcatgcaaaatgagttttccatcatgtatcagataaagttcatcacatagggattctaaatcagtggaaatatgggatgtaataagtatacttcggctctcatcctctgcaatataagcccgtaacatatctaaaatctcgtttctcgcctccacatccagtccagctgtcggctcatccatgatcagcagctttgcatggtgtgtcatagctgtcagcacgcggagtttcgctttcattccggttgaaaattctttgattttcttattcatcggaagttttaaattttcactctgttttataaaatagttttcatcaaacgaatgatacattttttttaaaatgtgttttacatcgtttacggtcagttccccggaaaatccggattctgcaagagaaactcctatatcctgtttgactttttccgaaagttctttactgtcacttcccaaaacagttacagttccttcctctgcccggcaaagaccaagaatcagtttgatcgcggtactttttcctgctccgtttttcccgatcaaccccagtatctgtccttccggcagttccattgatatttcaaatgtaaagtttccatatgttttccggacattttgcattgttatcatacaatttccgcctttcttttttatgttctgttgtctgactttttacatcaatctgaagcaaatacctcatcaagcatttcatgattgtgtcatatctatttcaaaagtttcttaccgattttacttctcatcgagaatcagttttacaacctcagatatttcttccttcttcatccccatggaaagtgcccggtcgatcactttatcgaagtcatcttctatcgctttctgccttgcttcaagtgcaagctgtttatccgaggcagatacataagtaccttttccatgaacagtcgtaacaaatccctcttcttccagcttatcgtaagccttcttgaccgtcagcgcactgatccgaagctcccctgcgagcgtcctcacagacggaagtgcctctccttcttttaattcagactgaataatatctgattttatctgctccatgagctgttcgtaaatcggaaccatggaggaatgatttaagataatatgcatacttcctctcattctgccgcttcagcggcttttcataaatcagggaactttgtgcgccagcacaatttccagattaaaaatgtcaattttcaatcttatctctctttacagcaaacagtatataacagtgcatatctgttgtcaactgttatatactgtttattctatttttttgtaatttcatgtgggaatttgtacagacaatactcgttaataactttttcatgaaaaattaaatttttgtgtatgccgtgcagaatattttatgttactatagaataaagtgttgcttcgcaattttctgtatttatgtcaggaggagaacattatgaaagtaaatctgactcccttttccatatactggttcctgtttttgatcttaaatgtcatatattttatatttccatttctattttttctgcttctgccggcagtgttcgttatgattttaatatggggaatatgtgtatttgaaattgggcgagcaaccattatttcttcacaaactaagcggataacacgagtcatactggctttcctggcatctcttcttacaatttcaataaatcccattggaatgattcttttggattttattaattggagacatataaactcattcgcacactatttttcgaaagcctattggattatttttttgattcatatgctgctattttggctgggcgaagaaataggatatttttcacagaaaggacttttttaatatggtaaaaataatttcagacagcacatgcgacctctcagcagaattagctgcacaatacgatattgatattctcccgcttcatattcttctcggagatgaggaatttgaagatggaaaaacaattacaccggatgagatttactcctggtccgatgagcataaaacaaccccaaaaacttccgccccgtctctggcagaaacgattgaactttttcgcccttatgtggaagaaggatgcgagattgtctgcttttccatctcaaacagtatgtcaacatccggcaatgtcatgcgtcttgctgccggggaactagaagcagaaaaccggatcaccgtgattgattccgcaaatctctccaccggaatcggacttcttgtgatagaagctgccattatggcaaaaaacggacactctgcatccgaaattgcttctgtcatggaaactttaaaaccaaatgtcagagcaagctttgtcgtggataccctcacctacctgtaccgtggcggacgttgtaacgctgttgctgccatggccggtggtgtcttaaagctgcatccaaaaattgtggtagaaaacggtgctatggatgcgacaaaaaaatatcgcggaaagatcaattctgttatcatgtcctatgtaaaagatatggaaactgatttaaaagcagccagacctgaccgcgtattcatcacacattccggctgtgacgctgcaacggtggaatccgtccgctcgtatctggaaagcctcggtgttttccatgagatattagaaaccagggccggtggtgtcgtgtcaagccactgcggtcccggtacgcttggtgttctgtttattgcaaaataatagaggttcggatgttttcttcccaaacctctgtttcttttacttttctatctctgtattaatctcatcttccgtagctttcattgcttccaaagtcattgtgagcagtttgtctaattcccagccaagctgctctgctccgcgctcgatcacttctctggagcagcctgcggcaaaccctttgctcttatactttttcttcagggatttcaattccatgtcttttgtgcttttcgacggacgcatcaaagctgccgcccagatcagaccggtcagctcgtctgctgcaaataatactttttccatctcatgctccggagcaacatccacggtaattccatagccatgtgaaaccacgccatgtatgatgtcttcgccgactccaccctcgcgcaaaagttccggtgctttgatacagtgttcttccggataaagttcaaaatcaatatcatgaagcagaccaacaataccccagtattctgcgtctgcgccaaatccaagctcctctgcataccatttcatcacagcttccacagtcagtgcatgctggatatggaaaggatctttgttgtactttttcaataaatcataggcttcttctcttgtgatatgttccattttcgtgttcctctttttctgtcattccgtcagatagaatttgcaattcatacttatccgataggtttttagttattttatactttttctcacaagatgtcaattttttatcatcacagattttattttctaaaaaagctatattttctccttcacaagtacttcttttcctgcaaatgcaaaaccatgcttataaatacgttcttcgttgattcctgctgtgacaagatctgtcacatatttttttcttctatctgccggaacgcactttcgactgtctcttccagatttttttctttcttcttatcccaaaccttaaattccataagaaatgcatcctgattcttctctaacggatacattgcaatatcatatctgccccgtccactctcacggtttgaaacaatacgatacctgtccctaagtgttacaatcagtccaagtatcagaccatgataaaaattctctggcgtgcgtgcctctttttcatttccaacatcaaaataattcatggatgtgcatgcaatctctgacagataatcattcatatcttctatattatgctccaacagagccttcacaaacctgttatatacggaaaatccattatgaaacattccaagaatctctgtacgaaacattgccataacttctttattcgtaactgacacatcacactcaatggtatctactttgtgcaccacattttcagccttaatataaccaacagataataacagtgaccacaaactgttctcatcgccatccagagactgaaatgtaatgttctcgttgatttccttatgcactttttcaccggacattaactgttcgatctcatattttcgcccgacaagatgctttctgatgatatcaccaattagtttattactgctcgtattcgtccaataagaaataagttctccctgcctgatataattgcagattgaccacggattgtacatatctttttgtttgccaaaaataaagccgtcgtacaaatccttcacatcccgcatcttatccaaattctgacatttcagtgcatccgttacttcctgctctgtaaacccgaaacaatctgcatatgcgtcacaggtaactgtgtctacttccagattattcagatccgaaaacaacgaatttttagaaattcttgctactccggtaataatcgcgcggctgtaataatcattctgcttaaatgcattatgaaatatctgtctgcatgtggcgatcatctcatcccaatacccctgcgtatacgcttcgagcaatggtgtgtcatattcatccacaagaataattggcagcaccttgtgatgtctgtataaaaagtagcatagccgcttgattgcctgccagtcattctctcccctgcttgcaaaaaaagattcttttgcctctgtaaactgctgtttttcactttctgacaactctgtactgtcctgcagataagaatgtttctcatacatttcaaagaaactgaacatcatatttttcatggattgttcataattcatacccttgcagcttccaaaactgaccgaaataaccggaatcttcccgaacatttcccgactctttttatctttccaaacgcgaagtttttcaaaatattccgggtgcttcgcatactttggatcaaaaaatgtctccacggtactaaaaagcgtcgttttcccaaatctcctcggtcttgtgatcaatgtgacttttgcatcgctcctcatccattcgctgatgaaatgtgtcttatcaacataaaactgtctgccacatgtaaaatccagaaaattatcatatccaagtcccacttttgcgtcaagataaggatttctttttaaaatatcttcaatacgctctttcggattttccatagacacctccgtgtaccatacttctgcacatcctgcaggatattatgctttatacgaatatacattgctattatttgcaaaaatggttatggatagttattcttgatatataactatccataaccattgtcaattattataaaaaagatttcctctatttcctttttaaatccccctgatttcaacgatcctgtcacattcaatatctgttccgtcttccagcacgattgtcctctcatagtcacggaatttctgaaatatccctgtggcagtcacatattctcctccggtctttttgtcatccggcttgaaataagttactgacactgtcggatgttctgtggcatacgcaatcaatgtctgtaatttttcattcagttcttcctgcttatcttcatcgagttccacctgttcttctgtcagtctcgctgtttctttgattgcagcctcatgtccggtcaatgcagcaaatggcgaaaactgcgccgccctgtcataaatcgacatctgtggatgaacttttgactgatgatgaggtaaattcagaatatccccatatttttcttcgctttccgtcatccgctttctcctttccttgactctctacggtctgcgtttcctgtttcaaacaaaaaatgtgcctctgaacgcatggatcactgtcttgttcgaaattctgcctgcttctatacaaaaaaatactttcaaaaaattcaggcacgatgcccgccgatctggttgtttctgtctatcatagttgcaccctcctgcagattggttccttttaacatcgcatttttaccatactttttcttcacggagagcattacctcctgcagtctgcgctctttttccattctcgcctgctctgccttctgtttctctgccagtgcctgataatcggtaaataaatccatctgtgtaaactctgtctcattcgataccatatgctcatccacaacacggttcgctgtgacagaaacacgccgcaccagaagattcttatccacaatgcgctcatataaatctaaaacggcgtccatgatttttgctgtagaagatgtttttgtatccagatttgctgttccgtgggcatgcttcggaacgaatcttccatatcggtctgcttttacctcgccatgatactttttccggatgtccgggttcgtcagattttcaatatcgtaaccaatatcgagtacaatctggtctgtcacaagctgtttctctacaaggtctaacaccagtgcatccgtcatctcgcggacgattagctttgtcttttcaaaatcataaggacagtgcagcacctgaccggaaccgatactgtttgtctccggcttatatcccctgatatccgcaatcgtgaccggttcatacccccatgcgtggtcgatcagaagttctgcattgatcccaaacattttataaagcagttcttcattataataatcccgttcttcacctatggaacatcgtgcaatgtctcccatcgtgtaaagtccggcctcctctaactttttccggtagccatgtcctacccgccagaaatcggtcagcggtctgtggctccacaaaagtttccggtaagtcatctcgtccagttctgcaacgcgcactccatttgcatccggtgcgacatgcttcgccacaatgtccatcgccaccttgcacagataaagattggttccaattcctgctgtggcggtaataccggtctcctgcatcacatcaaggatcatctttgacgcaagctcctttgccgccatatgataggtgttcagataatgcgtcacatccataaaaacctcatcgatggagtacacatgcatatcttccggcgcaatatatctcagataaatgtcgtaaatttgtgtactgtatttcatatagagtgccattcgtggctttgctgtcacataagtgacggaaagctccgggtgttccttcagttcgtccgaaaaacaggagcttccctcaaacattcttttcggcagcttctgcgatctctcctgattgacctctttcacacgctgtacgacttcaaaaagcctcgctcgtccaggaatcccatatacttttaaagaaggggaaactgccagacagattgttttctctgtcagttctgcatccgccacgacaagattcgtagtcagtggatcaagatctctttcccggcactcaacagaggcatagaacgactttaaatcaattgcgatataaatatgattttcatttccgctcacaaacgcacctccttcttctgctctattatatgtcattgacaatcaattcacaatggatgggatcgatataaattatggatgaaacaaatgcaatttattcgttgatttactcaccaaaatatgagatgataacagcattatgagtgaatattataaatttttccaaaacaaaaaatgtgaatattttccttgccataaaggaattccggaggaggattttaattgtctgttttgttattgtcctctctatacacttgggaaatcctgtggcggcaactgcgaatttttagaaaatggagtcaaatcctgcatgaaatgtggttttccgcatcagcgcagcaattatgataaggtcataagccgctttcaggagatcattgccgttatggcagcttcagataagggggacatgcctcatgaaatgtaaacttaccccacaattgtcctccgatgactggaaggatttttgcagccgttttcatttttctccggctgatcttccatatataaaagcgatttataccgcacttctcccactggtggaatcctgtgcgtattactccctcgatcaggatctggatgggattttcctccctcattatgcctatggatttgtgacacttggaaatggtatcgatgagctgtcagaattatatctggatcatgaacagatccaggaagcctatatcgtggactgcgtcagtcttttgcttttgtcaaaagcatacgcagaatttgcacaagtgatagaagatcaaagtggtttatcccttgcagaattatcttttctcggagatacctgttcccttgatcttcttccacaaatctatgaacgccttgcgccggatgcaatcggtcttaccgaaggtcagatgcttctgcccctcaaaacagctacgcttatcctgcatctggatacaaatacacacgcagccctcagacaattatgtaatacctgctcaacctgtaagaatctttcctgtccttccagaaaatctcctctgcaggatctgccgcatacttatggtgccatgcagatattccatataacatagcgttttagcaaaagatccataataactgtgtaactttttaataatatgagttatttatagcctgcttaaactgttctatatcctgagcaacaggatgggaaacagctaaaagagctgcattctccttctattatctaccgtctgtcagttcatcgatcagtgtgatcacttcctcgatcatgttgtcacaatgtggttttttctcaccaccctttgctgcatttgcacgcaaaagatctgcacaatctgtcataccgtcatgtttttttgcaatacatttccgaaattcattcaatacagccggcgactcaattcccttggcacctaataccatgtatcctgctgcgatcgctccacaggttgcaccgcatctcattccaccgccaaagttactgccaattgctgctgccagatcttcatccaacccgatttcctttgcatatacacgcatcaccgtctgtgcacagttgctgctaaccggcacttcacttcttaattcccttgctctttcagtgtgtttactcattttaaatatctctctttcgttttaaaataatgtcagttgctcgtaagtctgttctttcattactgcttcaacaaactcctcaagcctttttttatcttcaataacggatatttgtcccgcttcttctaattttctgtttcctgacgacagctccactaatttatgataataacaggcaagtcttttatattgattttgagcaaactcaactgtatgcattgtaccactttgttcttctgcctcaacaattaaaactccatcacttaagccgctttgcaacctgtcccggcgcacatactgatatttttttaccggtgtaccaactggatactcacttatcagacatccatccttcatcactatttcgtctgcaagtttctgattggattttggcagtatatcatccagacctgctggcagaattcctatacatcttcccccaccggcaatagttccttttaacgcctctgtatcacagccaagtgcaataccatttacaacattcacattcttttctgccagatattttcctgtgtcataggaaatctttcttcccttcagcgaacatctcctgcttccgatcacagcgatattatgatattcatttataatttcaatatttcctctataatataagagtactggtctgtcagttatcttttttaatgtatttggataccgctcatcctctaccgtacaatattctattcccatgtttttccacttgtttttattcatttccgcataatttaaaatatctgtttctttctgggaatacatattcttcatttctaaattgcctttcctaatgcaaacatttctacttgttttgcacctttttccattaaaacttctttacacgcatataacgaattccctgttgttgtaacatcatccattaacaaaatgatgttatccgtaatatccatattttcaacagcagagattgtctccagatggatctgtttatctctccgtccgccccatgccaacttgtcaatagattttgtccgttgtaaaaagtaaactttattgattcttttattttctgcaagtttctctgccaattttccaatacctgactctgttttctccgcattacttgaaggcacgacacaaattgtaacaccttcacatatttcttcatttaacaggttgtaaaaatagttaatagcagtttgttttccctctttcaagtctaaaattcttccactaaatacatcaaacaaaggattttttatttttctttccctatccagccaatatttatggtaattactatatacgacaatatcccctgtattattccattcttcatttacaaaaaccatattaacttcccccttatgacactgttttcttcctaaattttagcattaatttcatgcacaatacaatacgattctatcattctttcttattctttttcatttccagtaatttttcattcatgctctgtgcatctgcacggtcactcagataacagatgatattcacaacggcatagactgcaataatgagaacctccataagaagtaccatgctaaaattctggaaactgaaccactcaaataattttccaagccctaaaactacaatgttcacaaaaatgaaatataatagctgtctggcaaacattcctttttttgacagttccttcgatgcatctgagtcaaacataagaaccggaactgaacacaccgcagaaactgccaatatctgccagagtatctttacactgatctgtgcatcaaatcccccgaaaacagaaataaaaactgctgccgctatcaatacaccaaacgtgactttgccaaaaatatccatcaacatttttaatttctctgccatctcttcttacctcttttataatccaagccgttcttttaaaacaggcacatactgtcttgaaataatcgtcttttcgccattgtctaatactgcctcaaaacgtccgccaaaagctggcgataagctttttactttgctaagatttaaaatcgcagactttgacacccgcataaacgattcgaccggaagcatgtcctcaagtatatacaatttctctctcacttcgtaaacctcttttttgcaacaggcaaacactttgttgtcgaccgtttcaaaatagtagatttcatcaggctccagcagatgaataccatcctcactatgtcctgcaatcttggtgtttccctgttttaacttctgaagcagattctgtatatcctcgcttaaattctggcattttatgatgatctcatcctcttcaccggggattgtatccagtatggtgattttcatcggaattctccttttgatgcaattacttatagataattgcgaaactcctcataatcttctttcaattgttcaatttaggtttctatgagtttcgcaattgtttacaattactaaatacagaataccaagaattacgatacttgtcatcataataaatatcatctgatcaatacttacgacatgtcccccgaaaaccggattacaatctaaggaatccccgattgccgtcacaacctcatccggaaagccattcgccgacatctcctcaaagattccacgcagcatatgatttttcagcaaagaagtcccgtaagtccccggcagaattgacaatactttctgcagtccgatgtcgaaattggagattggcatatacgcaccgcatataaatccataaccggcactcacgatcgttccgactgctgacatctgcccctgtgttttcagcggataacagatgatacttgagagtgcacagccaaataataccagaaggatctcatccaaaatcacccaaagcacatccgtcacgctcatataccagcccattttgcacatatagacaaggcagacgaccagtgccagtccgttgaccatcagggaattgagtaatgttgaaagaaagtatcccagaaaaatcacagattttttcaccggggacacattaaaatcttttctcgcaccgttcgcaagatcctgcaccatcgtcaggttcacgcagaatgtcactgtgatacagctcacagacaaaagtgccgccgcaagctgtgccgccaccgttccgttgatcattttgtcagaaatctgtacggtatccggcaatgcagacaaaaaggaatctttatatacatttgcaaggaatgttgcatataaaactatcaaaattaccggtgtgatcagggaagaaagaaacatccccctgtcccggaagaaaagttttctgtttctgcttatcagagctgtcatcgttctcattcgcgcccacctcctaaggttttgcctgtcactgcaagaaaaacatcatccataccgccttttacaacctcataatcctgaaacaattcctgatgctccacgatcagtttcgttgcctctgacgtattatctacttttatccggtaaccatcacgtactttcttataatcataatgtaaagacttaatttgtgcttcagatacaccgtaaacagaaatcgtgtcctgcacatacctgttttttaactcgtatggtgttccttccgccacaatactgcccttgtcgagaatcaccacatatgaggcatttgcagcctcttccatgtaatgggtagtcagaaaaacggtcatctgctcctctatgcggagtttttcgatcacattccagatcacctgtctcgtctgcggatccagcccggtagtcggctcatctaaaataaggatctccggtctgtggagcaatgccctcgcaatgtcgatccttcttctctgtccgccggacaattttccgaccgggcggtttaaatagtcgccaaagtccaatatgtccagcagttcctgtaatcttttttcaaacgcctgacctgtaatgccatagagagctgcccgactctttaagttttcttttacagtgagcggcttatcaagcacactatcctgaaaaactacgccaatcagccgctttgtctgctcacccgctctttcgttatcgattcctttgatctgtaccgttccgctgtccttcgataactgtccgcagagaatggaaatcgttgtgcttttccctgcaccgttcacacctaaaaatgcaaacagttcgccttttttcacacggaaacttaagtcattgactgcttttacatcaccgaaggttttatttaaatgatcgatgcggatgatatctgtggattcatgttcgttctgcatattacacacctcttttttgttatatcgtagccatgagcaaaactccacatactcagtatttatgcatgtttgcgaggcatggcaacttcttttatcactccaaatttatagtaacaaccagctccaaatggtataattaagttgtcaaaatcaattcaccgagaggagctgattgttatctatcgtcaagaaattttgaaagacatccgtcttttcacttcacaaccagttgcaaagttttacgattcactttttctgaatctcgatttatcctttgtccctgaattccctaaaaccggacgaaaaggcttttccaatcatgccatgatttgttcgtttatcgttatgaaatgtgaaggcttttcaatgattacggatcttgttgattatcttaacaacaaccttctaatcgcccattactgcggttttgatatttctgctccgttgccttcttactggacgtttgatcgttttctaaaacagcttgataacgatgtactttcatccattatgaaatcccaagttctttatctttcaaaacaaggtattgttgatacatcttttattggtttggactctactccgattgctgcaaacacttcacagaataatcctaaatcttttctatccaacaaatttaagcctgataaccagcccaaagcagatactgattgcaaacttggcgtacatactgcttctaaccaaacaaacgagaaaaagtatgaattctactggggttacaaaaaccacgtccttgttgactgtatttcaggtcttcccatttatgaactgaccactaccgccaatgtccatgattccactgttgcgcttgatattttggctgacacacatacctttctgccgataaccgaatgtacctttcttgctgataaaggctatgatgttaaaaatatctataatcaggtacaggaactctaccaaggcgaatgtattattccattaaacaaacgatccaccaaaaatccaaaacttcttccacagggaaatcctgtctgcgatgccgggcttgccatgtggaaggatggtaaattttctgataatggacgtacacgccaaaaattctgctgcccactaaaatcaagcaaagacgctgattgtccctgccatcacaaaaatttttacaacggcaagaagcatcgcggctgtacaaaacacatcaccattcccgatgatttaagactctccgtcgacagagacagcaaatatttcaaaagtaattactctcttcgtacagaatgtgaaagatacaattcacgtttcaaaaatacagggcaggaacgtatgtgggtaagaaataaatcatctgttaccaacttgaatacaattgcccatataagtctgttagcggttgctgttgcggcaatcaccaccggcacagggcaatcctatcgtaagcttaaagctgtaaagcgaatcgcataataaagagctattcatatctccccatttgcgtaggttctggacttacgtcagctttgctatgtcataaattcccattctttccgatttacaaaagctaactgccaaatccaacttttaaatcaattcgttttgctcatctctcttatatcgttcaaccgaatttgctggtcaaaagtaactttactgctttttctctctgactatggtataacataatctgttttgaaaatctactggggataaggtaagatgcgttttaggggtggtaagctgcagaaaatctatttatttccaaaatccattcacttccaactcataaatcatgtcacacgcaatgcccgttccatcctctaaaatgaacattttatcataatcacggatttttctaaatattcctgtcactgtctcatatttgccgccctcttttctgtcatctggcttaaaatatgtcactgtcactgccagatgttcctctgcatgtgccatcagttcctgcagtttttcgttcaattcctccttcttatcctcattcagctctgcctgttcttccgtaagtcttgcagtctcccggattgtcgcctcatgcccggtcagtgctgcaaacggagagaactgtgctgctctgtcataaattgacatctgcggatgtactgtggaaacgtgatgtaaaagtccaatgatatcctcatactcttttttatgcatgatgacctccaatctgattatttcgttcctgcattcgcaagattttatccagtttttgccctgtcgaaccttcttttgcccgaaaaaaatcttttgtctataacaatttccttaaacctgtattttttagaaaagggaatgtctatgcctcagcaccaaacattccccttcgtataatagcagacaagtcaaatttaccggtactgatgagtcattgcgtcaataatatcttcatattttattaatgacacattccccatctctgctgccttttccatgcacccttttgtaaatccggtttttgagaacaggaaataatgtattttcgtgtaacgaaataatccactgcgttctatcagtgtttccagaatatctaaatcaacactttcatttctccacttacattccgcaaatattgccgaactgctatcctgctctcccataatatcgatttctgtctgacttctctttccagggtcatttccccaccagcggccaagcgatacaaattcaaccggcatatttcctgacagaagttgtttccataaatactgcgtacagatttcctcaaaaattctgcccatataatcgttgagttgtttttctattcttttataaaccaaatcggcagcaccacgggcaatgactgcactatttttcaaaacaaaacggtaccaaaaataaaacatattatcctctatggaataaattgtctttttcgaagctttttctccatagggtgtttcttttttaataattccaagattgatcagattcttaatgtatgacgtacatgtagttgtactttctcctactttggtagaaatttccgacatcctcgaatatcccgttgcaattgccgttataattgcgttataaattgcgggctctcttacttcctgcttcaaaagattcaccggctcctcgtataaaaacgacattggattcaaatatgtgtttttgatattctcttccacgcttaacttatcactcatctgaagcagatattgtggtgttcctccaacaattccatataccaaagctttatcttcatctgataaatcttttaaataagtgcagcattcttcaaaactaaaaggtgtaattttcatttgggcagttcgtcttccgtaaagaggcgatttatacgcaagcacctgatcttccatatatgacatagaagaaccacacaaaataagcatcaattttgactcatctttatacttatcaatcagcatctgtaatgtggaggcgagactttttgatgctcttgctacataaggatactcatcaattgccagtataatgcgttttttttctgccagcttaaatacatactccaaagctgcctgataagaagaaaaataagtttctgcccgaattccactgctgaattcaataatgctttggcttaaattttccagattctgtttttcactgctttctacacccataaaataaatggcttctttatcattaataaaatggttgattaaagctgtttttccaactcgacgccggccataaatcacagcaaattcaaacttatccgatttatataacctttctaatgcattcaactcactatctcttcctatgaacatactaatccctccatttttatatgcccactataatacgatttcataagaaagtcaattacgatttagtaatatatacattactaaatcgtaattgactattttccattaactacattatgttcttacagacctacagtctctttcccctgaacaattggatgccgccaatgtaaatcaatacctgcgcctcagaagataatatctttagggacggggattaggagtcgtccctgaaggtattactgacgtttgattacttttatcaaattatccacttatagaatgacctgtataaagctggtaatatcgacctttttcttcgattaactgttcatgatttccacgctcaacaatttttccgttttccaataccataatgcagtcagcatttctaatagttgataatcgatgagcgataacaaatgttgttcgtcctgccatcaatttatccataccgttttgcactaattcttctgtatgcgtgtcaatacttgaagtagcttcatctaaaacaaggactggtggatttgcaacagcagctctggctattgccagtaattgccgttgtccttgtgataagcttccaccatcaccggatataattgtctgatacccatctggcagcatacgaataaagccatcggcattcgctagttttgcagcctgtatacattcttcgtcagttgcgtctagtcgtccatatctgatattatctataatagtaccggtaaacaaatgagtatcctgcaatacaacacctaaacttttccttaaatctgcttttttaattttactgatattaatgttatcatatcgaattttcccatcttggatatcataaaagcgattgataagatttgtaatggttgttttacctgcacctgtacttcctacaaatgcaattttctgtcctttcttcgcaaacaggctaatatcatgaaggactaatttttcatcactatatccaaaatcaacattttcaaagaggatttccccgttaagctcctgataagttgtggtatcatctgctttatgataatgtttccatgcccactttcctgtacgttttgtactttctattaaatttcctttagaatcgcattctatattaactaaacttatgtatccgttatcactttctgatgcttcgtcaagaagtgcataaatacgattgataccggcagctgccataataatgctgtttaattgctggcttacttgcccaaatggctgattaaagtttttattgagcgttaagaatgataccagcattccaacgcttaaaccaccatatccatttaatataaggacagagcctataaccgcacatataacatagcttacatttccgatttgcataataataggcataagaatatttccataaatatttgctttttgtgaactttctttcaattcttcattaacacttctaaaacgtgctaaacttcttttttcgtaacaaaaaactttaacaactttttgcccacttatcatttcttcaataaagccattaagttttcccaaattattttgctgctgattaaaatacctgctgcttaatgcagccgcatttttggcaacgactaacataatagcaaccatgaccagagtaataaccgtaagcggaatatttaatgttatcattgcagcaaaaatacttacgattgttatgatactgttaaataattgcggaacactttgacttaaaaactggcggagtgtatccgtatcatttgtgtagatcgacataatatctccgtgtgaatgactgtcaaaatactgtattggcagtgactgcatatggttaaataatttaattcttattattttcatggttccctgactgacattcaccatgatttgattatagatataagaacaaagaatacctatgataatgtaattgttgagctgaccgagatatgaaaaactttctatcgtcaatttcgcattattgcaataacagattgcttcttccatgaatgaataagcaatattgtcatcaaactttcaagcataaacatagcaacagcaaaaagagtaaaagcaacaaccggaaatacaaatcccgtagacatacctgcatttttcaaaaatataccgattgcatatccgccggggattccaacaacagcagttataagcaatgcaatcaaagtagtaaaaagaccttccatcataaatgcttgctccaactgcttatttgtcataccaatagattttagtgtgcccatttcctgtttctgtgataaaagatttgtcacagtaagattgatttgattgatgaccgcaaatatccacaagatggctgcaatcgcataagctaatgtaaaacctgcacgattgtctgattggtgttctacaataaaatcttgaagggtttgtaagcgaacatccctattgtcagaaacgagtaatttgagttcttgctcgattatctcctgatattcagcttctgcttgtatttcgattgcgtatgtacagtcataacctgcaagttctttgagcatattttccggcattctgaaaatatagccacccattccatcattgctggaagtgattgcaccaattttgaatgcttttgttattgttttaccactatgatttttgaaattaaaggtcacagtatccccaatttgaggtttccaatggtaaacatcataaatacgttcgggatcacttacaactaattctgtatcatcagtaatatttccagacaaaaccgctgcatttagcgatgccaaatccttttcattatagccgagcatcaaggtgctatctgaaatatcattgtctgttgagaaatcaactggtacggtagcataagtaaatatattgctaactccctctatatctccaacacgctttacataatcagaaaaatattctttctgcaagagagcatccaaattttcactttcgttttctaaatcaatgctgattttgaaatccccgtacttcatatcccaataacgagccatactctcggcattaaaagaactctgataacttgctgcaaggaaaaatataactccgcacagtcccaatgataaaatggtcaatagagatttttttctgtttctggaaaagctgattttcgctaaatatacaggcgtaatacgatgtcttttgtgagtgcggtaatttacaattcccactggatttttcagggcggaaattggagaagtattcgctgcaatttttgctggtttacgaacactaatataaacaagcagtattccaaaaaggcatgcgccacatagagaaacaataaatgcaaatactgaccagccttttgattgcagacaatagctgatgatcgttcccatgatactaccaattaaaatcccaggaactgcaagcatataaccctgtttaagaactattttataaatttgctttttacttgcccctattgtccgaagctgtccgaactcagcaactttttgtccaaccgaaatatagaaaatgctgtaaattacaagtgcggcagctaaaaacaaaatggcagcaactacaccatataccgcataattactgaaggacaaagttgtatttacataatcatagtaactgctgactgtccaattattcagtccagtctcctctgaaatttgagataatatttctgttgcttcgtcttttgtaagggtatctgcattttcaagccaaacatatccattaagcaggtcatttccacgtaattcccggcatttttcaagtgaaacaaaaacaggataagcgatagaagttttatcatggtaaataccaacaatagtataattcttcaaagtaccatccagattcaactgaactatggcgttgatttccggagacttattttcactggcaaaaaaggcatctgtaacagcaatttcacttgctttctctggatattttccgtcaaaggcaggaatcaaactaagcatgtcatcatcataataaatcagagacagttctttagaattttctttcactgttttgatattacaggaaagtcctacactttttacttcttcgtttgctaacaacttttctttactgtcctgcgtaatgtcaaagaaaatcccttgatgtaatccttcgatttctttctgattttgataaatgatattttgcactgtgagcaacgacatcattatcatagcaacggatacaataattgccgaaaggcaaaataagtttttcttcttatcaaaacgcaccctttttcgtgctaattttttaattactgcactggtatcattttcaaaaggataattcataattcccacctcctttagccaacaattttaccatcttcaatccgtacaatgcggtctgcgagttgagcaatctcgttgttgtgagtaatcattacaatggtctgattaaattctccgctggtacgcttcaaaagccctaacacatctgcactggtcttgctatcaagatttccggtcggttcatcagcaaggataatcgcaggcttcgtaattaaagctcgtgcaatcgctacacgttgctgttgaccgcctgaaagattgttcggcatattttccagtttatcttctaaagccaacatatacacaacttcgtccataaatttctggtctactgtatcgccatccagttccacaggcaggacgatattttcatatacattcaaaatcggaaccagattataattttggaagataaatccgatgttacgacggcggaaaattgtcaattcatcatcattcttttttgcgagttcttctccccgtacaatcacgctgccggaagtgggggtatcaagtcctcccatcatgtgaagcaatgtagacttaccgctgccggaagttccaactacggcaacaaattctccctgttccatagtaaaatttacaccattaagggcacgagtaatattgggttctgtgccgtaatacttctttaagtcgattgtttgtaaaatgctcatattcaaatgctcctttcaaggctttctatctgttgataaagccattgtaaaccacaaatgttacacaaatgtccgagatagaaaaaatttttatcgaaaatcagggtgaaatgttacaacgctcggacatttcaaaaaaagtggttatatcttaccttacaggaagcataatagaaaattctgagccttgccccagctctgaaacgaccttgatatagcccccttgccttgttacaatctcacgagccaaatacaaacctattcctacaccctgttgatcgtgtacttcttcctcacgatagaagcgccggaagatggcagcctgattactttctgaaatgcccttgccggtatcggtcactttgacctctacgtacatttcccactgaaccactgatacagaaatctttccacctgacggagtgtattttactgcattgtccagcagattgaaaagggcttcgcttgtccacttgctgtcatgggagattatcaaattttccgggcaatccacggatacagcaatttcttttttctctgcggcatatacaatactgctcatagcttgtgcaagcgtatggaataagctgctgtctttcttttctaatcgtattgctccggtttctaaccgggatgttttaaccagtgcttggaacagaaaatccagtttatcagtctgactgcgtatgccttgcaaaaagtccatccgttcttcttctgaaacaggctttgttaaaagtgtgtccgttaccatttgcaaattgctgacaggtgttttgacttgatgcgaaatatcagaaatcagcatttgaagctcctgtcgttccatgtctaccttgtgccgattttcctgcataatctcatacaaccggattaagcggtggttgatacgggcaaaaagagtttcactatcatttgacttttgtaattcctcgtttccatcaatcatgttgtccagcgtccggcacaaattagaagtaaaatgagaaaggcgttttccaaaaaacagcaccaatagccaaatccagaaaaatgcacagagtgtcaatgttccacctgctatgaaaattcgtatatcctgcattataccgccgaaaataccggtaattaccagcatagagaaaaccatgccagcactaatcagtctacaaattttcttagcagaaaggttattcagtttcatttcttttcgcctcctgtccattgataacccataccgtaaaccgttttgatatatgtgtcgccatccgcttcaatcttactgcgaatgcggctgatagaagtagtaagggtatgttcatctacatatttttcatcaatgtcccacagcctttccaaaagttgttggcgggtaagtacctgcttcggatttttaagaaataggttcagcattttatattccatcgcagaaagcgctaatggtttcccgttcaagcttgcaaattgttccgaaaaatccagaaacaggctgccatcctcgtaaatatccttagctggtttgtgatgttccaacatagcgaacatggctttgatctttcgctgcaaagcactaatcgaaaaaggtttcgtgatataatccactgcaccagcttcatatcctcgtatctgatcgctttcctgatcgttggcagttagaaatataactactgtatcaggatgctctggcttgataagacggcataggtcataaccatttccgtctggtaaatttatatccagcaataccaaatcaaaaatgtttgtttttaatgattcagcggctgtccttgcattcagaacagaagttattgtgtaaccgtccaattccaaattataagtaagcgttttattcaaaagattatcgtcttcgacaattaaaatctgcttcatattgtcacttccttttctttttgcagatagtataacagacaaatgtccgagaattgttacaaggacaaatatatttttcattttacagcttttttctgtgtactgcaattttataaaagaaaggacagcagtgtcaaattgctgtccttacggcttattatagctggtagtgtataagcgtgggttcatcatatttggtgtggtatctttaactatgggaaactccattttcccagttagaaatagtctgcctggaaacattgaggtcttcagcaacctgttcctgtgtaagtttctttatagtacgagcatttttaattttatcagctatcataattctgtatgcctccttcttccatgagattacagcaaacgtagtagtaatgtccatcaaaaggcttttacatattagataaaagcatgtaaaatttcttttacataacttaattgcggtctatttagcttgtttcctgactactcaggaaaaatatttctaccctcgccccacctgtattttcagaatttgaaagtttaatacctccaccatatttttcagccacagtttttgcaaaaaatagtcccatcccataatgggcttcgccatttctacttgtgtcatccataaaaaactgctctgtgccatgcaataatgcttcttttgtaaatcctgatccgctatcctccacaatgaatgtcagccggtcatcctgctcctttgcgtcaatataaatgattccattttcttttgtatgctccactgcattctgaatcacattcattacggcccggagcattggatcataagcaatcgttacctttttatcactttgttccgccttccaatctatcttctggtgatagatttctaccagtccgagtgcctgttcctttatatctgcgaaaaaatcttctaacctcaccgttgtataggtaacatcactgcaattccatgattttgtgacatctatcaactgttttacataactttgtatctgtgttgtgccgttcaaaacataagtgatatttttcttctgttctgtggtcagttcagtctctgaaagtagttctgcatttccccgtacaatcgtaagaggtgttttaatatcatgcgccaaagcagacatctgctgtttcttttcctgctctgttttccactgcttttctaaagattctcgcaatgcatctcgcatatcatcgattgccgataaacagtcatcaaactctttgataccggaacaggatgtctcatattccagattttgatcctttatttgtccgattgcgtctaatacaggctgcatctgctttttgattctttttccaaaacgtatggacggaatgatgataatcgctaccgctccaatcactgacataatactcatcacattctgtggacctataaaatgctccctcaaaaaagctgaatgatattgaggtgtcaggcgatattgcaatacaacatattcattttcccttacaattactttataaaaatatttcccggatgcgtttccgtactttgcaacattccatgctatctgttcgtattgttctgacagatctccacctattttctctccattctctgaaaagattacataatcacaaagtgcaggaatcatctcagcagttactttatccgcacgtaaaatcgtatcatatgcttcattaatcttttgctctgcataattcgccggatagatacagcccacactaatcaaaagggacagcagcagccaagcaacaatcaccaaacctactaatgatccaagcatgaccagtacatatctcataaaaatccagctgagtgcattgcttctctttactcttcccatttatatccaatcccccagactgtttttatcggtgtataatcataatccgcaaattttgctcttatatttttgatatgcgtgataatggtactgtcattactctcactgtcaaaaccaaagacctcttctaaaatctgttctttcgagaaaacctgtcctctgtttttagccagaaattcacagatttcgtactccgctttcgtaagaggaagttccttatcatcaaccaatagtttcttttgagatatttgaatacagaccctccccaaaaccatccggacagaatgttccctgtgctctcttctaagatgtgcattgatccttgcccgaagttccatcactccaaatggctttgaaatataatcatccgctcctaaagaaagtccgtttaccagactgttttcctccgtttttgccgtaagaaacaaaatcggacaatccacaagtgccctgattcttttgcataattcgaagccatcaattccaggcatcataatgtccagtaaaatcaggtcataacgatgtaattcttccatattaatttttagtggattacttactttggtaaccagatgtccatccttattcaaaatgctttctatcatttccagaattgccggttcatcatcaactgccagtatttttgccatagtttccctcgattctattccgatattctgtttccttcccagtggtttacccaccaaaaatagtataccatactaatccctgtaaatattaagcaacctggtatgaatgacaaccattcacctacactagtttctcccaatacagattgcagataagtatatggtactctacccgtccagcagacaaatacatatttccacacataatctccaagtccggtaagcatcaatgcactaattagtcctgatataatccctgctccaatggataccccttttccaaactgaaaagccagaatcagctgccacagataaagtggaacactgcttccccacagcagcaatgctgcaaatatacatcctttcatgatttcgatatcgcttgatgcgattcttccaaatccaattccgaatatgattgctgtcaataggatagagcacagacacaaaaccagcagcatcaacagtttcgataaaaatgctgcaggtttatccggtaaagacaacagattttgaaaatcacctgcattttgttcctgttccatcacacttgctgtaaaaattccaataagtaccggaagtcctgctcctattgcctgataaaatgcaatcactttcatattttcattccatggtgaaaaaaagtaatatattaaaaatataacgctggttataatcggaatcagtaagtgtgccagaatcacagatgttcctttcatctttcgcaagtctgcattaagagatcttccaatcatcttatttcacctctcttctctcaaaccatttcaaaaacagaaccgttacaaaaacaaaccagatgattgagagacacattcccggaacaatgactcccgtatccaaaagaggattccctgcttctgcggcaagtccatttggtaaaacatgaagcaacgggcacatcattcgcatagggattgcagaaacaagtacataccagattctggtttgtgatattaccacaccgctgacggtaataaacaggcagacgaacaggtttacaatcattccaaatcgttcacttaaaaataaagctaccggaatctcccataactcagaaaccgtcagaaacaatactgcaatcaacgctcctccaactggaacatgtgtcgttagaagaaagcctccaagcgttgctcctgcaaacacaatcacattagaaaacaaaatcatgtacccaatataaataattttccccagcaacaattttcttctgtctgtgggaatagtcattaaatgatagtattttatctttttctcctgcgccacagaaagataacaaaatagagcaatcatccccggcagcaaaagtgtataccaccagttccaaacactttctgcataagcatttgtcatcccaagagtaaatataaatgccatgacaaatgtaagaagaggaaatccccagataaacttttttcgcatggttcttttggctttttgatgttctgcttttataatattaaccatggatttcacctgctttctggttttttcttaccacattcataaacaaatcttcaagattatctccctgctttaatgctccttcgtatcctaagattccacctgaaataatcccgactttatctgcaagtaactgtacctctgagagaatatgactggagagaattacagtgattccctgttccggaaaagaccggatcagctctcgtaattcctcgatgcctattggatctaatccattcgtaggttcatccaatatcaaaagttccggttctccaagcaatgccattgcaatgcctagtctttgcttcatccccaaagaaaactgtcctgctttcttctttccggtgtttgtaagtgatacaatctgcaagacctcatcaattctgttttcatctgtaccaagcaataattgtcttaccttcaaattctctctggcggaaagattttcataaataggcggattttcaattaacgctcctatttttgacaaatctttcctatcccaaagttttctatcaaagtaaatctttcctgcagttggtttcatcataccggtcagcattttcaatgtggtagattttcccgcaccattcggtccaagcagtccgtaaatctggtccttttctatattaagtgaaacattatttaccgctttctgctttctaaaatatttacatagattttgtgtctgtaacatcatttccatctttactatccttccttctatatttcatttcttactgaaatataacctaacagaaaaaaataaagatttgatgaagatttattcccgtatggaataaaccatcaattgaatatcattatcagaactcggctttccactgaaatcagcaaagctgttacaaatacaaagtcctaatttaccgaatatctccttcaaagcatactgctccgcatccaagctcttttgctttttccagagaataatccagtaaaatctttccataccccttccttttaagctccggtgcaatacagatcggtcccatggtcatttctgaaaagccacattaaaagtaaatgtacttccaatatgttctttaaaaaatgctctatgcttctctgtgcagacaaaatcaggttcaatttttgtatccatataaatgtcagatatcggagctttcaccctcttttctcttggagcagatagagtttcgcctgtatcaaggtaatgagctatcctatctgttatatctatttttccgccagatacagacaatccattttctttacaaaacttaaccagttcttctttcaggaagtaaaaatcccgaaatgtcttgctgcccaattctttatttaaaataggtctttccaatatctatttcccccttttctgttttggtgctggtaactccgcatacatagcatcaaacaatccgatcatgaatttcttattatccacttcctctaccaacagcatcctctttgctccatcatatggcaattcatacggagctgtcggcatataccggacagctgattttactggtttcacgagtaatctatcatcatagataccacctacgattttgcctcgataataaagaataaattctcccatcatggtgcgatatgtgattccttccaattcagataactgctttggcgatggtggtgggatcgcggtttaacgctttcgctatcttgcgaatgcttttgtcttctttcaacagagaatatatttctattctccgacattgttaaatgtttgtattttgccatcatttttcctctttggcttctacgggacatttaacattatctcacttccaacctgtttgcacaactaacttccgctcgtggacgttttccctacctatgtggactttaacttttcatttcagctaaattagcatacaaatcgcattttctttgtcaatcataacagaaaggacgaatgctcaaatgccttcgtccccaaaacggttatatatttagtattaattgttgtaaacttgcaatgaaaacatctacaagtttagttaattgtgcatttcagcaaatacatactatttgtaatctttgtttttgagcgacgtaccgacaaacggtatcgttgcaaattcccgagggttactacgtataacgtaatcgatataattagccaccatcaatgcgtaaacatagtaccccatcgggttcggatggaagcccagcccgaacgacttacgcatttcggcgtcgtatacaggcgcatgcgcagtcatatccagcaagtacgtaaagtcaaacatgtcgcacaatttggcaagttcgcttgcgatataacgaatatctttatcgcaggcatcaccgcgaagttgcggagtaacgacaaaaatacgcgcatttggctcgatcgttttaagtttgcaaacgatttgtcccatattgccgaagaatgtatcggcgttatcctgcggacattctgcgttaacgtccttgacgcttcccaacggatgtccgaagacaaacgaatcgttgttgcccagcgcaatgatatacgcttgattccattgccaaaatccgtttgcatccgcccaactttgcatatactcgcgcgcagtcattccaccgcgagaataattgttgtacttcgtccccgtaatgcgctccaaaacagcgggccacgaatactcgtacatatcggtataaactatgctgccgttttcgtcgtggctttcgaactcacccgacgccaaagaatcccctatcactcctatttgtttgaatatgcctgcaaaaccgcatgtttccttgataatatccaacggctgttcgtttgcgccgagttcaaaacgtttgttatccatttttattcaccatcctgtgtttcttctttaatttttttgggcttatcccattccgtacccgttaccgttttaagatccagcccgcgagtttcgccgacaaacagccacattattacgattgcgcccacaagccccggcacagtcaaacccaagtacatatagccgaacatcttttcgggaatgataggaagcagtatcatagtgataaccgttgcaagtccgcccataactccgttaagcaacgtgttgattacagttacggacgaacgcaagtttgtaggagaagactcggagaacattattccgccgatagtatcgcccgcgccccagtaactgcccataaatccgccgattgcaaagcctgtcaaatacggagtccacttgaacataccgcttaaaataaacagcaaatagcacgccaacgccgaacaagacatcgcaattatagttattttgcgcccgaatttgtccgacacaaaacccgatatcaacgtaaacagcgcgttgcctacgggatacaagaatagagcaagagttatttcttcttccgtcatcaaagcagactttgccataaccgtactgtacgttgccgtacctaacgaagcaagatagaaacaacagcaggcgatgatcaaaaagcgtaattgcctgtgtttgaatgcgaattttacagcggtcagaattccgccttgagcgttttgctcgcactcttccttactgcgttgttcgcgttcttcgatgggagtttttaagtactctattctttttgttaaaaacgcgtttgtttcctttgcaaaaagcaacgcgaataacgccattacaaaaccgataattgccggaactaaatatacaacgtgccaacgctcgcttacattttgcataagcgtagccctaagcaacggaacaagcaacgtacccagtatcgccaccgcttttacgattgcgtagttacgggcgcgggacttttcgtcggagcattccagtatgtacacacattgcatatcgtgcgacaccataaaactcatcaacgtgctgcctatcatgtaaacgtagatatccttagataaatacacaaggaacagccctaaccccatacataacgtgttaataaccaaaaacggcttacgcccgaatttgtccgcaaggggacggtagaaaataataagcaccgttaccggataggaaataaaacctatggcggaaaagagcgataatcccgcgccgtattccatacccatattttttacgaagaattccgtaactatattcgcctgaaactgaatggatatagtagacgccatttcgtccgttatgtagatgagcgacaaaatcataaacaagtaaatcacataaaacttgttgcttcttgcgcccaactgcttttcgcggcggataagttctttggcttcgcgcgcctgtaatcgttcaacattttttgccattttgagttttctccttttgaaaattgtaaacaagaaaattcttggtcatctcgtcggtaatgccgtagcgctccgccaaattgcgtatggcttgcaaaaaatccgcaccggagcaacccttggacaacaggttttctttttcgataagtttattccaaaaaacattcaaaactatttcgtcggtggcaagagaaacaaccgaatgattgcgcgtatgcacgtaaacgttgcgatcgccctcttcgccgactaagcactctccgccatcgattatgattgttgttctgcggtagggaaacagagttgaaacgtcgttgatattgtacgaatacaccgttgcgccggcgaccgaaatactttcgaaggtaaaaatatgcacctttactccgcgagatattgcattttcgatattactacgcagcacttcgaacgactcccgccaaatggacagcgaaatttccgcttgcgcgctgtcgataagttcctttgccttggcaacgtatttttcttcgcccactatattcattacgtaatcgatgtcggcattttccgttgcgagttgttgaagttcgcgttcggcgcaggcaatattcttttcgttttcttccttaatgctgcggataaggtcttgatactcgataggcttgtaaaaattaggttctccgtctatacggatgaccgcgccttttgcaatcaaacgattgatgacctcataaaccaacgaacgcgcaacgccggacaatttggcgatttcgtagccgtttagcactttgtgttttatcaacgtgccgtatacttttgcctcgttagatgaaaaaccgagtttttccaaaaattcaaaactattcatagtagttatcccccacaccactattgtattgcaaatctttccgttgtcaatctctttttaaaatatttgatattaaatttgcgttttttcgtcaatacggactatcgtcaaagtacagttcgttgtataaatcgccgtctttcctatcgaaacgttcttgctgctcgggtgtaaaagatacttttaacgtttctggtttacgcaacgtaaatttgccgatatcgcgtctgcgcgtacgattgattatatgggcaaatgtatgaaggctttctacatctactataagttttgctcgatcttccagtgaaattttatccctattcaacattctgacagcgtttcgataaacagggtttggaattaacattgccgttccccaattggtattgccagcttttacaaggttgtctaacgcttcttccttccaattctctttgttttcaagttttgcaaaatcaagacatcttgccttgcccttataattagaatctcccatacagagattatataagcaattagccttattaattattatctcagcattttttctacaccatgtaagttcatctatacatagttgtttataatggctttcagccggggtgtcttttttattttccttcaagtcaacctttataagttgtttgtcatctactggaatcataagattgtaattcagctctcccaatagttttccttttttgtctattatcttatcaaaatcagctcttgggctcattctcttgtgtttttcaaccgggtgtgataatagaatcagatatttgcgattattgcagccaactactgtacctacatatattcgatgttgctttccaatctgtggtgacacagaagaaactctgtcatcaatattatgcaaattcctaatatatttcatatctatccgatataaatttagtctttcctatttcataaaactcctggatattaaaagtggctatgctaaaaagcatagccaccatgaagaatcaccagaggcgattcttacgcttttacgacctccacttatagatagtacccacctttaatattaaattaccaaaaagccagaaatagtcaatacattttcagaaattatttgtaccttccttatctcacatagtcaatcagtttcgacctcaatcgacagatattttcctctgattatcacgtttcttggcttctgcaatcttctcatgaatattggtattgtacagcttatacaaatccgtagcaatatattcagtttcttcaacactaaatccatattcctgagctacttcttcgacccttatgtatctttttattacgtataataacaaatgtattatctgtgttgaagataacggtataggagcttccgatgaacaaatagaaaagctcaatcacacaccgcattatatggtctgtgatacaaacactaccgaacaacgacatggtttaggactgctgattgtgaagcagattatgaatggtcatagtggaactgttataatagcgcacagtgaatattatggcggtttcaaaacagagcttactatcccactataaagtgtatttgaaagtgaatagtaatagattttatctcctttatcacaccaacagacaatacgattaaaataaattgctttccaaatatttattaccttaccacaattcccttaattttgaatgagtaaatcacgcaaaaaaattgcttgatttactcattcgcttattaactagaaaaagtacaatgaaactatcaaacgaaaaggagattaaaatatggcaacattattaaaagcaaatgaagtagcaaaaatttatgccaaagggcagcgtccaagtctgaataaagtatccttcaatgtagcagaaagtgaatttatcgctattatgggtgcttctggctctggaaagactacattgcttaatgttctttccaccattgatacccctacaagtggcagcattgtaatcaatggtgttaatttagaacaactgagcgacacaggtgcagctgatttccgcagggataatcttggatttatatttcaggaatactttttacttgacagccttaccatccgagaaaacatctctgttccactcactttgcaaaaacttccctataaaaaaatcgaaaaaatggtgcagagtttagcagaacgatttggcattgcatctcaattagacaaatatccaaacgagctgtctggcgggcagaggcaacgggcatcggcggcaagagccattgtaaaacagccaagtattttgtttgctgatgagccgacaggagcattggactcaaactctgctaccgagttattaaaaactttgaaagaagcaaatgaagaattgcataccactatactgatggtcacacatgatgcatacgctgcaagttttgcgaaccgtattctgattttcaaagacggaagcattataagggaacttcttaaacaagatgccgacagacgaacattctatgaagcaattgcacaggaagtagccaaattagatacggaaagataagggggcaaaattcatgaataatttatcaatggcacttaaaaatcttaaaaaaaatttttcattttatgcccttgaattgtaacgatactatccattttgggcattgtatgcatgtttatcggtcatattttccttaaaatgtttatctgtcgctatttctaccagttcaggaagcgcttgtgcagcatttgctttagcttttgcagcagcacctcgcagtgatcgtgtatatatggagccggtaaattcatcaggaagatccgttcctatgtatataatatcgctgctatctgccattatgtaaaattcgcctacatactgctttaaatatttttctacatctttccaatcaattccacgttttcctttaaagataatatcattgatcattacaatcttatttccgttcaaatctgttattactgatatatttcttcatgattttttcattcaaaattttaattaattagtgtgcggaacaattaccgcacatcaattaatatatcacaaaaagcattattgtaccaccaaacatgattttatttagccctctgtgttttccactttgttcagctttactctttgtttctccgattctcataaagtaaaaacgcacagactgtctctcatcgaaacaatctgtgcgtctcttttctgatctgcaaacgctgctttccatatgttatccatatctcatgctttcatttacagatatattattttgtttttacaccagcttacttgacctgtgcatccgaaacactgaccttatgatcataccattttccttttgtgccgatcagtgcaagatcaaactcctgatctaatgcttctaccggaacgtcaaaagcataaacttcctctttggaaccatcagagtatgtaacttcttctgttgttggctggatcagttttgctccatccttctgtgcatcttctgcagttcctaagaaaagatttacaatgttctgggatggcatcacgatgtgaagtgtcattttgccatcctttaccgtaagtgttccacgtccgtcatacacttcgttcacatgaaacatgccgctgtcagtgtcgaattttgcagaatatgttccgtctgcaagagcttcactcttgcttgcggaagaaagcatagcagaaccgagggattcgatggctgcttttgtatgggctacataaatctgctggatagcattgatcccgccaagtcctgcgatctggcagtcaacgctttcaaagttaccgcttgcaacaaactggctcttccaggaatcctcatcatcacctgccatatcgttattggcatgatctccggctactaccattaatggacgaaggattacttttgtgtaaccagcttcttttactgctgcgatcacgttctcacatgctgtctcttccggctcaccttccactgttccaataaatacgttgtcataacctaatttttccatctgggtagccatctggctatagcttacttttgcagtgtgggaagtaccatgtcccatgaatacaaatgctgtaccatcttcttttgctgcctctaaggaatcaaaacctgcggtttttactgcctctgctgtgatagcttctgcaacggctgctttatcttcattgacaacagctgcatcgtctccgacttcgccgagcaatggttcagcaactgtaacggtctcaaatttatccttgtagctgtctaatgcttctacgagttcatcatactctgcgccatgcattaaatgagttggctgtacaacgagattttttacaccattttctactgctctgttgagtgcctgttctacattgtcaattttttcaccatctcttgcctgtacatggttgatgatgatctgagctgtgaaagctcttcttacagaccagtccggatttgcttcctgcagtgctttttccacaccaccgatatcctctgccctgctgtcgttgaaggatgtaccaaaacttaccactaaaagctcgttctctccgattccgtcctcattcaaaggatcatccttggatgcatctcctgtatctcttccgaaataatccggatcagcattttctccctctacaagttccttctgtgcatctgtcagcttgtcccatgccgcttttgctgctgcacactgctcatctgtgttctcatttcttgtctgaacatagatggcatcgatgagtgctgcgacttcgtccgctgcggcctgatcatcgacctcttcactctctgtctcagcagctgtttctgtctgtggctgtgttgtctctgtctctttcttgcttccgcatcctgtaaaaagggctgctgtcattgtaaacgcaagaacaagtgcaagtgtttttttcttcatttttttctcctctttgtgatttacttctgcttcatagagatctgtacacaaagaaaaaatattatgccctatcttttataatacggcaaaaaaaatctccggtcagatgtcctgaacggagtaaaaagtcaatgaaaatcaggcttttgtcagaaagccctctaaacagtacgaccaattactcgtgatctgggaattcatttccctgtaccagacgattggcaggtttcctggctgaaagatcctcatacagattctgccttcccagtgccatgcaccagtggctttccatgcggaaaaagaatctgcactcccttatcacagtgacgagatcgtacaggaatcacacctgtttcccttttaaccagtctggtcttaacaaaaccggctggcaccaactgtcttctctatgaaactgtcatttttttacgcttccacaccgcatgaatgatatagcggtctaaagccttatccatgttagcacacccatgttttttttgcaatctcaaatgtgtttttctgttctttccaaaaaccattccacaaactttggatctgacggataatacagatgtggaaagccccagaaatgatcgtccgatgcatgaatgcacttccagcttcttccggtcaccggttttgtgacaatgcaatcctctccattcgctgtgctgtcgaaatagtggaactcatgcgcctttattttttccggttccggtctttccgctgttcccttctccgtgagcccttgcggcagttgtacttccacataaccaaaacgtaccagttttcccgtgtactgacactctgccgggatcacaccaaccataggaaaattttttccgtctttgtctgtgagtgtctcatgcagatacataaatccaccgcattctgccagggaaggcagatgctgttccaacgcttctttgatcgactttcgcatactctcattttccgcaagctgtttggcatataattcgggatagccgccgcctaacagtaagccgtggatgttgtctggaagcgttttatcatgcagcggtgaaaaatagaccaattctgcaccataatattccaacattcttaagttgtcacggtaataaaaacagaatacttcgtcttttgccacagcgattctaggcgatattgtatttgtatcagagtttcctatatcatatagtttatttttttcattggagattgcttgcaaaaaaattttaactttcccagatgcttctttttcttccaaatttttttctggcttcatttcattttcttgctctatttcatcttctagttttgtttcatcatcttctacagtttcttctttctctcgcaaagcgcattccgcaatcccgatcatcgcatcgacatccacatatttttccaacaattgtccggctttttccagctgaaaattcagttctttcatttcttctggcagaatcaatccaagatgtctggaacctaatgtcaactctttttcatttggaatacatcccaatgcttttatcgaaagttcttcttcgatcaatggtgcaatggtatcaaaaaacattttacttgtccggtttaaaataacccctttgatcagctttttctcgtcatactgtaagaatcctgcaatgagcggaatcacagattttcccatgccatgcgcatccactaccagaataaccgggacatccagcgtcttggccagatggtaggaagatccctcctccctgattccgccaagtccatcgtaaagtcccataaccccttctaacactgcgatatcgtgtcccggcagttccatctcatataacgcctgtatctgtgatgcatctgaaaaaaatgtatccagatttttggatggaatttttaacacctgttcatgaaacatcggatcaatataatccggtccgcacttaaaggacaccggatgttttttcctgcataataactgttttaaaaaagcacatgtgatggttgtctttccactgccgctttttaccgcagcgatcataactttcggtattttcaatcccatttaagatacctccccggtaaaatcaaaagagcagatgtaaattggattttctccctgcatcagatgataaccgccgactgtttttgcacgggatacctgcacctgaatgatctcgagatccgtgatacggctgtctgtttccagcaatgtcagttcacggatcgtctctaaactgatgcagttgatcacgatcctcatttcatgattttttttatataaaacatctaagatttcttttaatctgccactgcttccaccgatgaacgcatgtgtcggatgctcactccgttcttctgtcttaagacagtccggtgcctcaccggcgattacctgaatattcggcagagcgaatttctcgatatttttctggatcagttccagtgcaagaggctttttttctatcgcaaaaacctggatctgcccacttctttttgcgatttccaccgcgacagaacctgttccgcttccgatatcataacagacggaatcctcttttaaatgcaatttgcagatagacaacgctcttatctcttcttttgtcatcggaactttatcccgcaaaaattccttatcccgcatcccacaggtaactgtctttttttctgcatccggatttaagatgagacatatatataatccggtttcttccacatgctcacatgcttccggcgttaatgccaaaactttctcctgcggataggacagctggaaacctgcaagtaccttacagttctgcaaatgatatttctgtaacagtctgccgagtttttgcacatcctcttttccggacatcagcaaaaatgttttcgcagaaaaacgaatggtctctgtcagatttccgatccactctgtctccgctccgtgtccatggatacttaaaacagccgcatcctgataactgtacccggtcaatgccgcaaaataggataccgatgaaattccgggatagatacgcacactgctgtcacttctgcccttcagtgtttcatatagtttcccgcatccgctgtaaaaactggtatcaccggaaaaaagaatgaccacttttaccccgcagccggataaccggtccagctccgggacgatatccgctgcaagatagtagggataacggactgcctgctcattttttattatccttagcagccgttctgctccaaaaatgtaatctgcttcccggattttttctgttgcttccatcgtgagcgtctgctcatttcccataccggttccgatgagggcgatctggttttttattgtttttcccgtgatttctgaaatttttctgcacacctgtgcaaaagaatccccactgttttgtttttccggattgccgatcacacaagcagtgattccttccgcctcggctgcttttattttttccagaaatcccccggttctgccactctcctttgtgaccagatactttatatcaaactgtctaatcagtgcgcggttcatctccaatgaaaaaggaccctgcatcgcaatgatctgttttccacagataccgttcttttcacacagcgagaggctctccaatcccggcaatacacggacaaacaggcggtcttttaacgcttccttccgactgtatgtggcaagatctttgctcccggtcgtgagcaggatgtttccatctgtgaagcttaagaagtctgcacattctgtggcgtcactgcacagtatcacatctgagtgattttcctgtattgtatccttatttaacgcaatatccgaagtctccctctgcagccggatatatggaatctccgtatttttcaggctttccctgatgttttccgaaactgccgttgcaaacggatgcgttgcatccaccaccgctgccaccccactctgtgcgatgaacttctgcattttctccaaatccatcctgcctttatgaaccgtaactccttccatctccggcatgacgatctcaccatattctgttgccacggaaacaatacagtggattccattttcagacaatgtctgtgctaacatgcgtccttctgttgttcctgaaaaaataagaattttattcatgaatttctttctcctgcttgcacgattgtcacatgcaaattaaaatacagcatactttaaaccgccggatccggcagcacataccctctcggtgtgacaagtttcccacctatgattttcgttctggaatttccaataaataccgttgtaaacatatttacctgacgctcccgcaattctgcgagtgtgcagactttacaggctgtgttttctcttccgatattttccacatagccacaggctctctccggctccactccgtttttttgtaaaatgtcacaggccttcttaagataatctgccctgtggtggctggagggattatagattgccatgcagaaatcccccatcgccgctgccgcaagccttttttcgataagctcccacggtgtcataagatcacttaagctgatgacgcagtaatcatggtttagtggcgctccaagcgccgctgccccactgtttgccgctgtgatccccgggatcacctcaagttcacatcccggatgcgcttccgacatctcatagagcagggatgccattccatacacgcctgcatccccactgcataccatcgcaaccgtttttcctttttctgcttcctcaaaacacatctcgcagcgtctgacttcctgtttcatcggtgtggataaaaattctttttcccgatatttaccgcctaataattttaaatacaccggatatccgacgatcacatcgctgccgcacaatgcatgatctgcctgtggagtcatcatttccccggttcccggtcccattcccacgatataaattttactgctcatcgatcctgtactcctttgccagttctctttccaatttccagtcgtattttacaattgcgattgtcatgccgttttccgcctgcttcctcaaaatgaaagttccttcttcgtttgccgctttcattgcagcccgctcgcagacattgtccacgcctgtcttttctcttacaaaggaggactcctgaaagtctccctttacctgttttaactcctccgcagaataggttaaaaacggaatccggtttgccatgcaccaccgcagcaggccttcctcctcttttttcagatcaatggaagctgctgcgcgcacaagttttttttcaatgcctgcatgatccagccacttttgtataaatgcattcagttcttcaaagctttttcccctgcggcagccgattcctaaaatatattctctcggctgcaatccgagtactccctgctctaagtctgttttctccgatgagatcacaatatccggcgtttttccatccagtattttggctgagacttttgcgatcccctcccggttataaatggaaagaccacatttttttgcaaacagatccacagaaaacgcatgattcacatcggttgctgttgtgatgaccggaatcccgccgatctgccctgcaatctgttctgcgagctcatttgcacctcccatatgcccggaaagcagcgggatcacaaaagtccctgcctcgtctgccacaaccaccggactgtcactcagcttatccgacacaaatggtgcgatcatgcgcactgcaatgccacaggctccaattacaacaatggcatttttctctgcaaactgctgtcttgtccagtcagatagcgataatccaaggttttttgcttcttccgttttcgcgctcgcaaaagcctgtctgattttttctgcaagttttgttccgttctctgtaaacgtaataatactgatattcattctttttcccttgatttttttatcttacgaaattccgtctcaaaatccggcgcatacagtctggatttcccataatgctgatgtgccacaatatctcccacgatgatcagcgctgtttttgtaatgttatgcgcttttgccgtctcttctaactgttccaccgtacacagatacgcttcttcctccggccaggtcgccttgtatacaatcgctgccggtgtgtctttcccatacccgcctgcgatcagccgtctgcccagttctcccagcattcctgtacttaaatagattgccatggaagcatgatgtgctgcaaaactctcaatgctctctctctccggcactttggttctgccttccatgcgggtaatgatcaatgactgggacacttccggtaaagtatattccagatttaacaaagctgctgctccaaaacaggcacttactccaggacagctttcatacaaaatacctttttcatccagcagatccatctgttcccgcactgctccgtaaatgctcggttccccagtgtgaagccgcactgtcgtaagctcttgtttttctgcctcttccatgacagcgagtacctcttctaaggtcatgtatgcactgttatgtatctcacactcttttttgcaataagataaaagttccggattcacaagcgaccccgcataaattaccacatccgccttttctaacagacgcattccacgtaccgtgataagatctgccgctccaggtcctgctcccacaaaataaaccattgttttgtttcctttctaatttatgtatttgcgaaacccttcataatcttctttaaattgtgaaaaattaacaaaattttcgaaaacacgctttcgctatgtgtcgctggtaacggtccttagtgttttctcaagcttttgttaatttttcacaatttaatttaggttttcaagagtttcgcaattgtctaataaatcacattaattcctgtaaaaacttctctgctccagcggactttgccagctctccaaattcattggagtaaaggataacctcgatctgcattttccctgccgcccgtttgttcagataaaacatgatttttgacagcagctcctgcatcacagcatctttttttccacaggcatccagtttcctgactgcttcttccgtggtgacacattgcaggatttcctctaaaaccggataaggcacctgatttctcacagaagctgcggcaagcacttccatacggcagtctccctctctggaatgtgtgttcatgattcctcctgccactttcacaagcttgccgatatgtcctgtgagcagcattttttcaaatccagtggtgatcgccatatcaatggtgtctccgataaaattactgcactttacgctccggtcaaggtcgtaaccatatgtttttttcatgtaatccaacccgtaattaccgggcgaaacagcggcgattccataaccttctgcctttttctggttcaattccactttgatcgtatcaagaagcgcctgactgctcatcggttctacgatcccggaagttcccaaaatggaaattcccccgacgatcccaagtctcggattgaaggtctgctccgccaaatgttctccgtcgggcaccgagatcgtgatatgaagttctccggagaaatctgccaatgtgcatacctcctgcacttctttttcgatcatctcccgcggcacatgattaatggctgcatttccgaccggctggtctaatccgggttttgtcactctgccaacaccctttccaccgtcaatgcaaatgactgcccttttttcctgcatcgctttcacatgaatgcctgaaaattgtctgttattctgccccggtatttttttctccccatctgcaaaacgcactgtggaaaaaatgagtgtcccggatgtaatatcgggatcatctccaccatcttttcgtactgcgcaggtaacttctgtttcacttcttgtaatttcaagtatctccgtttgaaacagaatccctttcggtgtctgtattgttatattttgttttaactttcctgtcagcagcatatatgctgctgctttcgaggaagccgccgcacagcttcctgttgtaaatccatatcgcatcattcatccactcttgcatgattttcttatggtctgcacggcaactcagcaggccagtgaatccattacttaaatttacatttaatttccatctcgaagttcatataaaagtgcattgcagattgccgctgcaatgttactgccaccttttcttccccggttgataatatacggtacatccgtttttaaaatcagatcctttgcagcctccacattcacaaagccaaccggaaccccgataataaatgccgggcggtattttccactctttatcatttcatataattcgatcaatgctgtcggcgcattgcctatggcaaagatcaccggcttttctatctgtgctgctttttccatgctcacagctgcccttgtgacaccgcgctcttttgcaatctttgccacctcttcctcagccataaaacagtgtgcctttcctccgtattttgccagttcttttttattcacgccggcaagtgccatgtttgtatcggtgacaatgtctgcaccattttgtatcagtttttttgcaatcccgaccgcatgggcggaataagtcatggtctttgcataatcaaaatctgcgctggtatggatggctctcttcgtcacaagctcctgctcttttggaagaacgattcctttttcctccagctcttttgagattatggcaaagcttcgtttttcgatatcctgtggtctgacgtattctatgttttccatctgatcctccttactttcctgcagtgttgatatgggtgattgcgaaacgctttataatctatctcgaattgtgaaaaatcaacaaaaacattcaagacacgctctcgctatgtgtcactcgcagcggtactaagaagccagtcacgacttgcagtcgcacctgccttctaagaaccggcggttccccaatgtctttcatgtcttttgttgatttttcacaatttaatttacactttgaagagtttcgcatttatccacaattgtatcctttaattgcgcaatcaatttttcattctcttcatgtgtcttcactgcaatacgatagtatcctgtacgtagtccccggtaattgctgcagtcacgaattaaaatttttttcttcagcaaatcattatagagctgacgctctgtctttatgagcaggaaatctgcttccccggggtagactttgattcccagcttttccagttccgccgttagatatgcacgctcttttccaatgtatgaaatggttttgttacagtattccgtctcatccaatgccgcacgtcctgctgcctccgcaatgattgagatgttccactccggcaattgattgaaaatctgccctgtcttgttctggctgccacagaataagaagcccagacgcacacccgggatcgcatataattttgtgaaagccttcacaatgatgacatttggatattcctgcatggaatgtgtttcaaaaaatccctttttccttgtaaattccagaaaacattcatctatcacaacggttatctttttttcccggcatctgtcacatattttttccagcagcacgtcttctattgtattgccaaccggattattcgggttcgccagaaataataaatccacatcctcctgcaattcctgcagaaacgcttcggtcaggcagaaaccgtccctctctttcatctcataataggaaacctctgcctctgtcacgtttgcggctttctcataaccataaaaggacggcaccggtattacaatttttcccggtttgattgcatggacgattgccataaataactcagatgctccgtttccgcacaaaatatgttcctccgggatgtgatagtatgctccgattttttcgatcagttttgcatggtgaatgtcggggtaatgctcacagagttccaaagattcctgcattgcctccttcactttttccggtattccaaaaggattgatattgaccgaaaaatccagttctatttcattttgatagatgtctcctccgtgtatgaccggacgcattttctctcctcctctctgtcctaagaaataagcaggatgatccaaagtaccgacagacagattgcttcacacaggatagccgtcgcatacagtaaccggtttgcgcgcttaatatcttctgtctccaccgctctttctgcatccccgatataaggcttttgcacgatttttccaaaataacttgcgtttcctgcaagccggattccaagtgcacctgcacacactgcttccgtctgtgccgaattgggacttgcatggttgtaacggtctctcttaaaaatataccatgcacgctttccgtcaaactcttttccacagaaaaaacaggaaattaccatgagcagtgcgctgatcctcgccggaatgtaatttacgatgtcatccaattttgccgcagttctgccaaaatacagatatctgtcattcttatatcctaccatggaatccatggtattgacagctttgtagaaaaatccaaggattggaccgccgattgctgtgcagatcatcggtgcaatcacgccgtcagaagtattctctgccacagtctcgatagctgcctttgcaacgcctgtctcatccagacattccgtatctctgccgacgatcatagaaaccactttccgtgaggctgcaatatcaccttttttcagttcctgatagactttcatgctctctacttgcaggcatttcgtggcaagaatctggtaggtcataatgctctcgatcacaaccccaagatacggatgcagtctgtaagcgccaagtaaaagcacagccgtcacaaacaccgtactgctcaaaactgcaagtacaagcagcattcctctcctttgttcctgctccggtgtggtatgtttttcttccgttttgctgccgagaagtctcttttccagaaaactgatccagtttccgatcagacggatcggatgtggcagccagtaaggatctccaaacaacagatccatgagaaatcccgccagcatggcggcaatatgataaatcatgatttaatttcctttcttatctattgtaaatgttcactttttgagtcctcacatcatatcttagtcagacttgttatcttccaactgccctggatccattccagcacagtttcatatccttccccgtttttcacctgaaaatcaaaatattcccctccggtaaaactgcttaacaccgccatgatcgtaccgccatgcactacggccacgaccgggatttctgttccacaattgcttttcagatattgcggatctgtgccgttttgtattccggtgttcttttctgatctttttaaaatatcagacatcatccagtcaaaaccttccatggaacgccggataaactgctctcttgactctccaccgggaaatggcagtgttccattgctgtcgatccacttctgatagcagggatcgtcctttaattcctcataatttttcccctcaaactgcccgaaatccatctccttccattccgggatcaggattggattcctctcaaaaagcagttccgctgtctgaacgcagcgtttcatcggagatgtatacaaaaattccggtggactggaaaaatattccttctttttttcctgtaaaagacggattcctgtttcagacaacggttcatctgtttttccaatataacggtgttctccgttcgcctgtgtcatgccatgtctgatccatgtgatttttgcttttattttatcttctgtcctattccacatatgatgcgctccactgtctccgcttcccctgcaagccggatcaataatctgccgacacgttccctgtattcccgctcctgcttctccatcggcacaatgccgttgccaatctcatcgcagataaagatacaatccgggtgctccttataatattgcagcacgatctcttccgccggttttccctcctgtaaaagctgtttcacccagagatgcaggtcatttacaaccggtaccttctgccctttcagtttttcctgcacataggcaagcttgccctgcgcatatcctccgatatataattgcatgctttttctccccttctgccgaatactattttaaaagttacaggaaatatccggtcaccgcaaccgcagctgccgcagccgcctcacagactgtcacaaaaaatccggccgtgtcacctgtgataccaccaagctctttgtaacttttctttttaaaataaaagaaactgagcagcaccgccccgattgccgcggctccataccatccggatacgagcagcataagtaccacacaaagcactgcctgaaaatataaggctgcttttaccctgactttctgtgcactggaagcaaaggtatacaaaagcccctctttttttgccggctgcaatgtcataactgcaatcccactaaagcatctcgccagaaaaaatacggctgcaagcgcagacactgccttttgggtatgtatttctgaaattgctgcgatatcgatcatataataaagagccagcatgatcgccgcaaacgcaccgatatgggaatcttttaaaatctccagctttttttcccggctctggtacgaatgaaatgcgtccatcgtgtccatgtacccatccacatgaaatccaccggagatcattaacggaattgccgcaccgatcagtgcatagcagacatttcctaccgcaaatttctcacataacactgcccatccgaaaaaaaacagtccgatcaccccgccgatccacggaaaaaagcacatcatatactccatgtcctcttccttccactcgaactgcggcatgggtattttagaataaatggaaaatgcgatcgccatcgcttttaataatttcataacttcatcctttcaactccaccggaattccgaccacgacctctgccacccggtctgccagacgcgcaagtgctgcattgatcctgccaagtgctctcaaatactccatcgttccggcatcatagattacaccatcctcaaatacattgttcgtgacgatcacaaggttgtcgagtttctgtgaaagagtctgtatctcagatacaattttttcaactacttcatcctcggatttcatgccgtctttcgtgaacatttcgtttgctgtgagatttgacatacactcaagaagcgccgatttcttttctgagctgcactgccctttcctctctgcttcctgccggtattgcgcctgccctggttctccagcacatacaaactggatttttcctacattcatcgggctttcaatcgtaagaaacccttttcctgcccgcagtttccgatgccgctctacttttttttcgccctctgcatcataaatctgcatggttgcaatataatatctgattccttcgcaggaatacagcaggctttctgcatatgcagattttccgctgccgcttccccctgtcaccaatgtgatcatcctgataactgcacctttctgtcacatgtaaaaaatatgttcacactgactttatcaaaacctgtgatactcctcaattttaaaatcgccaaaagtagcccctgtctcatataaactcatggcaatatctaacagggaaaacatcatgactgcccccgttccctctcctaatgcaagtcctgcatccagaaccggagaaagccccagctcccgcatcaaaagttccgaagccggttcctttcctttgtgggagggaatgataaattcttttgttcccggacaaagccgctctgctgtaagcgctgccaccgcactgatgacaccgtctgccacgatcggcatatggtattttgcaccacctaaaaacacaccgcaaagccctgcgatatccagcccgccgaccgagcataaaatacgcatcggctcagtctctctcaactgatatttttccagtgcctctgagatcacttgtctttttctgacaagcccttcatcacttaatccggcgccccgccctgccacgatctccggtggaacggaaagcagagctgctgccatcgctgcacttgtcgtcgtattgccaattcccatctctccggtaccaagcagcgtatatccagcttctttgcactcttttacaagttccatcccaacccggaccgcctgcatggcttctctctctgacatcgcaggttttaacagaaaatcatttgtacctttttttacttttctgctgatgactcccggaaaaatccggtcggtgttcacaccgatatccaccggaaaaatctctgcgccaactgtttgcgccattttgcagaccgaagtatttctttttccgagattctctatcaccgctgccgtgatctcctgcccggactggctgatgccttccgccacaacgccattatctgcgcacatgacgatcactgcttttttcgcaatatcaatctctggcgacccaagaattgccccgattcttgcgagaagtccctcaaactcccccagaccatccagcggttttgccacacgatcccagtttgctttgatttcctgcctgatttttttatccggttcctctattttaaattccattatttttcctctttatgcactgcgcattttcgttactgttcactcgtacctcgttccagtaacaacatttctgttttaaatcgcagcttcccgcagcatcgcatacactgcttccatatccatggatttccgcacaccgtctgcaagtttatcatactgcatctgcttaaactgcccgtaacttatcatctgtccggtatccagcaccactcccttccgttcagccaggataccaaccagtgtctctgccagcgttccctcgtcaaaaatgccatgaacataggttccatatacgttaccggaaaagattccgtcgtattttacactgccatctgcttcgttttgtattctgcatacatagcctttttcgtcacttctgctttccggctgtctgacattctcactgtctacggtactgcccatgtggatctcgtatccgcgcacgctctttccggaaagtccggagagtgctccggaaatttctccaaaagttcccgttacctgtgttcttgttttttcctgtttcagctccgtcgcagccggaagcagtcccatgcccttcatgcttccaccgttttccacctgatatggatcgctgatcgtctcacccagcatctgatatccgccacagattccaaaaacaatggtatcctgcgctttctttttgatcagcgcctccagaccattttcccgcatccatttcagatctgccattgtatttttgctacccggaagcacgatcatgtccgggtggtgtaagtctctcacactgtccacatagcgcacggaaacctgcccgatctgctctaagacagacagatccgtaaaattggaaattcttggataacggatgactgcaatatcgatcaggccttcctccctgcggtcaaatctgctgcttaagctgtcctcgtcatcaatggacagctccatataaggcacaacgcccacgaccggcacatgtccccgctcctccagcatcacaacgcccggatctaatatggttttatccccgcggaatttattgataatgagcccttttacacgttccttttccggttcctcaagcagcatcagcgttccgagaagctgtgcaaacacgccgccccggtcaatgtctcccacaagaagcaccggtgcatccagaagctctgccaatcccatattgacaatatcattctccctcagattgatctctgccggactacctgcgccttcgatcacgataatgtcgttatctctttctaactcccggaatgcctttttgatttccgggatcaactgttttttatacgcaaaataatctctggcgctcatattcccaagcacttcaccattcacgatcacctgtgagccgacatgtgtggtcggttttaacagaatcggattcattgcagctaccggctccacccctgctgcctccgcctgcatcacctgtgcgcgtcccatctcaagcccttcctttgtgataaaagaattcagtgccatattctgggatttaaaaggtgccacccggtatccgtcctgtctgaaaatcctgcagagtcctgccacgatcaggctctttcctgcgtttgacatcgtgccctgcaccatgatcacttttgccataattctatctccattccacagtcttctgcctcctgcaaaagctgtctgttaagcacattctgtgatccaaataccgtctggcagcagatcacctttctgcatgcgcacatcacctgttttgccgcctcataatgttgcctctcaaagtcctgatacgcctccgcagcgatcacctgcaccgcaagcgcttctgccgccggataatcaatatcattttttcctaagatccccactgcaaatggaatcccgtttctctgaagctgccggaacagaaaactccccgtaccatttccggcgatcacaaatacctccggtatgccatcgcactttttcagttccacacaaccgtttttctcctgaaacgttccgtccgtgatctcataaagctgatcgacaaatccatcggtaaagacttcctccggcgtgccataatgctcaatgtttttccctttaacgcagacaattttgtccgacacacgctctgcaagatcaagttcatgcagcgacatgagaacaccgatttttttcttccgcgtcatctcctgcagcatggataaaaattcgagtttgtactttacatccagataagatgtcggctcatcaaggatcagaatctccggctcctgacacagcgcttttgcaagcagtacacgctgtttctgcccatcactcaggctcataaaattgcgttcttttaacggtgaaatgcgggtctgttccatgcactgcgccaccaccgcctcatcttttggtgtcaggatgccaagtcctccggtatacggatatctccccatcgccacaacgtctgccactgtcatcaactccggtgtgatgcgctctgtgaaaacaatggacattttcttcgccagttctttttccggcaattcacacagactggtgttttccacataaacactgccacagatctcctgcagctgctttgcgacagtctttaaaatagtggattttcctgccccgtttggtccgatcaatgtcacgatctctccccttttcagagaaatccctatctcctttatcagttcttttccgtgatatccaacggacagtccgtccgtgtgtaaaagttcccgttcttccattccgttcctcattttccattgtcaagatatttcattacctaccgaatgcctggatgcatgcttctcacaatttcaatttttcttccttagtaccgctcctgtcgctgcttcaacatgactgcgatcattaccggtgcgccaaaaatcgccgtcacggtactgatactcatctccgtcggtgcgaacaccatccgcgccagaagatcactgaacatgcagaatactgccccacctaaaaaacatgccggtatcatgatgatcggttttgccgtccggaataaccgctttaccatctgcggcaccgcgatcccgacaaacgacaccggtcctgcaaacgctgttaccactgcggataagatgctcgataagatcacaagcagtacgcggaacattttgatattgacacccatattttttgcgtaagtctctcctaactggtacgcctccatcggttttgacaaaaagaatgtcaaaatgccggtaacggctacaacaaacacgatcgttttcacattctcccatgtgatgccggaaaagcttcccatcgaccagttatgaagattcacaatgtcagaatcctctgcaaatgtcacaagaaaatctgtgactgcagaacagatatagccgatcatcactccgatcagtactaaaaatgacatattctgaactctcggtgacatcagaagcacgcaaaacatcgacagcatagatcctgcgaacgccgccacgatcagatccacagaagatagtgttctggaatatcttaagaacacgatcatcacgaccgccacaaataattttgccccggaagaaatgccaaggacaaacggtcctgcgatcggattatgaaaaaaagtctgcagcagatacccggacaatgccagcgcaccgccgagcaggattgccgcaaacgttctcgggatacggatctgaaagagaatggctgcataaagttcatcctgttcccctctgaactgtctccagatatctgagagcggaatctgcacacttccggcacatacactgatgataaaaaagagtactgataatgtgatcagaatgacaaaacagaccgtatatcttatttttctatttgagcttatacatgtaggtaagttcatccgtatcctccgagttcagcatctcatgaaaatcatggataatgcttccggtatccattgtatcctgataaaggtttttcccgatacaccatacatttccattctggactgctttaaaatctgcaaaaagactgtttttcgccagcagatcatcaatggaagcaagattgccgtcgatcgtgctgttatagacaagatagtccgcatcttttgcctgcgcataaaattcttccatctgcatattgacactggaagctgcgttatcttccccctttaaattccggaacacatactccccaccggcaatgtctatcattttcggaacatagtcattgctctttcgcacactgaccgttcctgctgttgtaacataaaaaaatgcgactgtctttccggtcgtttccacatcggaaagttcctgtacatactgtttctgttcctcaaatgctctcaccgccgcatcctcatttccggtcagcactccataaagctttacccactcggtcctgccgagcggatcagactcatagctggaatgatcgactaaaaccggaatgccaaacgattccagattctcctttacctccggtgaatgtccgatcatcgttgactcaatggcaagcccgcactctttcgaacagatcagttcataatcaggtgcattatactttccggcatatacgatctgtccgctctccattgccgcctttgcctccgggatctcccatttttcttcaggcagtccggacaggcagatgtgatccagtgcaccgatactgcaaaacatatccatagccgcagaggcaaccagataaatatcggacaccggggcatttaagactgtgatcccattctctaaatcctccggtacctgttccccttcggtattcagcaaaaatctgcttccatccgatatggaaatcagtgtaaaaccgttctcataataatccactgcaaactctgtggcataatctaaatccatgctcttttcataattcagttcactgctgatctcatgatccccactcttccaggaggtctggctgtctccacagcccgatatctggatgcaggcaaaaagcaatatacaccacagaccgattttttttatctgcttcattctttttttccttttctcttccgatgtatctgccacgctgtgatacttactgcaatcacggctgcgacgtagacaactgcgatcacttccatcggttttttcccggcgtttgcaatggaagcactgtcgagcagaatcgtatattcaatctcatgcggcacgctcatggctgtcgtatctgccgttaccggcacttctttgtcaaaagcagtcacaggcagttcgaaaacagaattgccctctgtattgaccggaagataagtctctccgtccatcgtcatatagtcataattagggctgctccactcgatctcgatgacggccttctcatcctgcacctgcagaattgccggtgatgtgacagacgccctgccgcttccccctgtcagctgcacttcaatctcatactctccatccgggagatcaacctgtattcctttttcccatacttcggttccgtttccgttgctttgcattctgtttttctctctttcctgttcgacggtctgttccagatgatgttctatggagtctttctgcctgaatatgaaaaaagcgtctctttttcacaaaagaaacgctgcactcaaatcacaatataaaatttttcctgtcctatcttacaaaaatgatctaaaaacaggtcaaattttctcatccgtacagccagttactcgtggcgtggaaacatttttgtttcccgtacaacaatcaggcaggtctcctgacttacagatcatcatgcattgccctcttcccggctgcccagtgagtttttggcatgcactccctaaatacagtgacgagttcgtacaggattcgcacctgtttcccttttcaccagatccggcagagtgaggtcaccctgcctatctgacacctgtttgtttcattatcaagttcgtttgaactataacatatgcttttaaaaatatcaatcgttttccaaaaacctattcaacactggcaaaactattcgcagcgatcatctttttcaattgtgtggcagcctccttaaatgggtgcgtgctgtcatagatcagacagatattccgggacggtatcttctcacacaggggtatctctgacacctctcccctgtcaatcgcatcctttgccatcggttttggtataaaagccagccccagtccgcttcttaccagtggaaggatctgatccgccgttgcagtctctgtatccggctcaaagtccagaccataagaagcaaataactgcctgtaaaactgaaaggtcaccgtctcctttccaagacagatgagcggatattgcataatctcctcaaatgttgtttgctttcctgccagatgcccaaactctgttccaccgatcagtatttcctgatatggatgaagcattgtcatgtggagcggtgcatccgcttttacaggtgtggaaacgactgcaaaatcaaccgttccccttctcaccgcttccaccgcctgcggtgtggaatgattgtagatcttcagccggattcccgggtatgtattgtgaaactcttttaacttatccagaaggaacaaatttaacgcggtctcactggctccgattgcaatactcccatgggacagtcccacacattctgccagttcctcctctgccgtaaaaagctgttccatggccgctgctacatgtgtatacagcttttccccttccgtagtcagaaaaactccacggttcgtccgcaccagaagcgtacaatgaagctgctgttccagacagttcattgcccttgtcacattcggctggctgtttcccaacacccttgcagccctcgtaaaattattatatttcgcaacgtaataaaaaattttataatactcaaaattcacatccatagctcgccctcaatcatatcaaattattatttctgctatatcaattatagctttcacatatttctatttcaatagtataattttagcgaaaaaaagaaaaggaagcgattcatttatggcagaaaaaacaatttttccacgtgaagaaaaagcagatgttttattcaacaaaatattaaatgatccatgggcatgtgaaaaactccaggggactttctgcaattccctgttttgcaatgaggataacaattttccattatctcccgctgaattttcccaggcactttttaatgcttatcacaacagagatctgtcagcttttcttatggcaatctgtcaaaatacattattcgatctgctccggaattcatttctgattccgtaccgttttaacgcagacggcagaacgaatccgattatcatgactgacgaatcgggcaatttactgcccggatataaaacaaccgtacatgaaaaaaattaccagcatttttatgatgtctactgtgatcttgacaataagaaaaatatttattttgcacaggcctaccgttaccgccatgcctatgcttctgaaaaaatggatatggaacagcagattctggaaaaaaataccggtgtactgatcatccgcgagctgcccgacactgtcaagctgaaagagacagaggcagaagcttattctgctgtctgggatcttatgatcaaactggagaaaagtcttcctatggcgtacattttctatgggcaggattctctggtagaggaaaacacccgttatgatgagattggtatttttctaccggattcgctgtttttgaagaatctggaacgacatgtaaaaaaagcagaggcgatcatttatgcagaagaataattatatggatatcatggaaaaaaatcatatggaaatcccctggcacgattacacggaaaacgacagcaatgttctgatcaataaagcagggctgatcgagaaggcttctgttatcggaagagtcggattgatcatgctctcctgtggaaccggagcatggcgtgtccgcacttccatgaaccgtcttgcaaaggaacttggtgtcacctgcaccgtggatgtcggacttatgtccatcgaatttaactgttttgacggaaaagaatgtgtctcacaatccttaagcattgccaatacaggtgtcaatacctcaaagctttaccgtatggaacagtttgttgacaattttccaaaacaggaagcccatctgacaggtgaagagattcacagacgtctggatgaaatcgagtctattcacacactctactcccctgccaaacttggtctcgccgctgcactcgcatgttgtgctttcacgttcctgctgggtggtggtccgattgaaatggttctcgcctttatcgcagccggtattggaaatgtgatccgcaccaaactgatcaaacaccattatacgttatttttaaatattgcagtatcaatctctgccgcctgtctgacttataccgtatgtctgcatctggcagaaatgttattccatattccgtccttccacgaggcaggatatatctgttccatgctgtttatcataccaggatttccattcatcacaagtggaatcgaccttgccaagcttgatttgagatccggactggaacgcctcacttattccgtgatcatcgtgctggtcgctactatgtttgcatggatcatggcattgctcttaaaattgcagccacaggatttttcctcattatccatcgatcctgtccttcatctgttactgcggttgatcacaagtttttgcggtgtattcggattctctattatgttcaacagttcgatcccgatggcagccacggctgcctttatcggtgccatcgcaaatacattgcgtctggaactggtcaactttacggctacacctgccgctgtcgccgcttttataggcgcattaaccgccggacttctggcttccatcataaaaaaatggaacggttatccacgtatttcactaaccgttccatccattgttattatggttccaggactttacctttatcgtgcaatttataatttcgggatcatgtcactgacagaagctgtctcctggtttgctgctgcgatcatgatcatcattgcgcttccgcttggtctgatttttgcaagaatcctgacagaccgcacgttccgctattgcacctgatgtaaattttttctttccattaacaaactttttctaagatttcatttaaggcattgccactgctggaatgacttcttaccacttcggctttgctgcgctccgcctccgctaccgcacattttaccatcttgtgggaaactgtattggtaaacaggataatcagatccggtgacccaatctggctgcttaactttgccggcatctgggtaaatacttttgccttacatttatgctccttacaaatctttttatactgacacaccatacggtcatgtcctccaataatgactacgctcataaattatcctttcgttataacgcttaccttattataatgctgcgagctgttttccgaggtctttgcatgcatctaaggctgcatcgtccggtgcttcctggcagatcacgccctctccgttcataacggttgctccggctgctgtcatgcggtctgcccagtcgcgcatccactgtccgtcgccccatccataagagccaaacaaagcgattgtcttacctgcggcaaatccttccacatcacatacaaatggctccatctcgccttcttcgagtacttctgctcccattgcaggacagcccattgcgaaaccttttgcagcttttaaatcatctaaagatgcacttgcgacatcaaccaccactgcttcttttcctgctgccgttacaccctctgcaactgcatttgccatactctctgtgtttcctgactgtgaccagaatacgattgttactttatccatgattctttcctccatactacctgcagttttatgtttttattttttcacattcctgcattttctattctttatcagtttatgaagttagtatacgctaacctataaataaaaattaagcataacaggaagccatctcgctcacactgcgtccacttgcaagcagttgtatcaaaacttttcttgcctcttcatatctgttaaacaaagccttcttctcctctacatgtccgtacactttccagtaaccggcatacagataattgtgacctttgttctcaatgaatccctccacatcttccacaggataaccgagcaataatcccatctcatgtggaaattctgcaatctgctccatacagtctgcatagcgtttctgaaaacggcttaaaacatcgcttaaatccaggctttcgtatccaaaactcttcatcgactgacagactctatcctgcatcaggtacgctttcaacccatcctcgcggtacactaaaaaggttgctttatcttcgctttccaacagcagataataggaaataccggaacgttccaacacctgtttcatctgtggtgcaagttttttctccacattcagtaaattagaaaccttcatgccggagatcatcggtgcacactgtacgaccagatgtgtctcaattctttctctgtctaatcttgtgatcatctcatatacttcctgactcactttgctctcctttgctttttatggttagtcatatctaacttataggcatatattacacaaaaaaagaaaacgtgtcaacactgttattgaaacgttttctcgttaagcttctatctcaattccttcctgcacaaaaatgcgcagatcataacaaaaatacagcagaccacccatgtgaccggttcgcaaaggcacactgcaaaatacccatataccggcacaatccagatagcaaaaatcacctttccaattaattccagactgctgcacacaagcggcatcatcaaatgattcattccctgcagcatatttctcaaaataataatcactgccatcgtaggaatcagcgggaaactgatcctgagatataatgcagtattataaataatatccacattactgcttcctgttaccagtatgacagcatcttccacgaagaaagtgacaaaaatcatggaaaaaatccaccagattgcaaaaagaaagaatgctgaccatactccttttttgattctgtttcgatttccgccgcccatattctggctcgtataagttgcaacactcgttccaagcgcaagtcccggcgtatggaaaagttccgccagccttcttgcgcctacctgcgccgtaatatacagatttccaagtgcgttgatgcttccctgtaaaataacacttccaatattatagattgcactcatcaaagccatactaaatcctgcaacaaccatttcaagtacaaattttttctccacctgataatcatttcttttaaaatgaagcagtggataattgcgccatataagtatgaacgccagaaatgcacttactccttgtgacaaaaccgttgcaaacgcagcacctccgattcccatcgccaatagtgccataaacacataatccaatgaaatattcaaaacgctgctgaacagcaaaaacaaaagcggtgtcatactgtttccaaccgcctgcagcatagcagcttccatattatatgccatcgtaaatggtattccaatcagtatgatcgtaagatattccatcgcacctgccattgtctcttccggaacctgcaaaaggattagcagaggttctttacacaacagaaaaatagacattaagacaatggataccgacatggaaattgttaccatccagcaggaggcatgcttcattttttgctcatcccctgctccaaagctgcggcttaaagacaacgccagtccattgttcattccaaatgcaaaattcgtgataagtccatatagcgccgaaactgctccaatctgtgcgagtgcgtgatctcccagaacatgtccggcaattgcagtatccgccagattataaaactgctgcagcagatttccaaaaaacagtggcagcgcaaattttaatacaagccggaacggatttccccttgtcatatccagcacacggcttttttcatttgtttccatcgtaatccctgctcctttaatctttactcagaaaccggtcccactcttcggcatctgcgcttccgcttactttaatcatgaaagtatggtcttccgtatcaatggataccgtatagacacctttctcctgctcaatggaatagatttcacatccttccagttcctttaattttgctgcctgatcttctgccgcgatcagtatatcctctttcttttctttcagattaccatctgcgtcataaactttatagccttcctcgacaaatgccgtaatctccggctcacggattttcagtttcagttcatttgcacgcatttcgcggatatcacgattgcacgaattttgtggtaaaatcgtcacattgtccaatatcatttcaaagatcccattgactgcgcaggtttctgcaatgtatgcgccctcaaatctgaagttttgtaattcattttcagtatagtatttcatttgttttctcctgtcattgatatcatatctgtaaattcattcatctactttactttttctgaccgtctactcctgcagctttttcacttcatctaacgaaagtcctgaaatagctgcaatcttttcagatgtgaattcctttaaagcaagcatacgctttgctgtttcaaaagctgcctgatttttgccttctgccagtccagcttcatgtccaatctcacgaccagcctcaaactctgcctttctcaacttcttctcttccaattctttatcatactcaaaaatgctcatattaataacctcacgccggtttcggataaggaattctgtcaggattccttcccggatacattcgtttacagcacgttccactgcctggttcaattgcatgtatgccgcatagtgacgtactttggcaacatactgtgcatattcttttaacatactgcaatgctgcatcaactctgcattgtgtccttcattgacattgaaaaccgtaacaaccaattcaagttttggctcgcctgacaaatgctcaaatgccgaggaaagccgaagttctgtgcaatcagcaattcccgtcgaaccattataaaattcaataaaattgggggcaggaatcttctgtaaggtggaagagaacagtgatttcaaatgccagatcatttttcatacccatatatatggcattctctaatgtaacaatttccaactcttccgggtttttataatctgtctgattcactgcgttataaagcgataacagatttttcctgtcagaaaacagcatccgaaagacagtgtctttataatttcggtttgcctttggttctttgactgtaaaactcctttttgtcctgttccggtttcttttgcattttgccataaatcgtttcctcctgattttggtgggacagttcataataaacactgtcctaacaggagagtaacagatactatctctaaattcgttcgtctcctgcttttcaattgttgatgggtaacaaaaagcatagatacgaatgaaacacacagattatttgggaaactaatctgtagttcttagaatatagatgacaaaattgtcatgaagattttgtaaaatatgctttgtttgattatagcacaaaagcagaagcagaagcaagaaaatacttctaccttctgtaccaactgagattgtatagacgctattctcacagtctatagaataaatttcacagcacaggtcgtagaatctacctctacgaccgcctgtgttaatttaattcgagcattctgtcaatacagcgttttgctcccttacttacttcctcaggtaaaataatttcttcacctgcaaggcctttcagacaattatatacatctactaaagttgtaagtttcatattgtggcatacacaatccttggaaagtggataaaacagcttatccggacactcatactgtaaatgggaaactatgctgttttctgttccaatgataaattccttatctgtactcttcttcgcataggacataattccagttgtgcttcctatgtagtctgcattcttggttactgcagcggcacattccggatggacaagaagcttcgcatttggatgtgctttctttgcttttgccacatctgctttgcccattctaagatgagttgggcaaccacccttgataaatttaaaagttttctcaggaatctgttctgctacccatgctccgaggttacagtccggaataaaaagaatcttgtcgttctccagcttcttaacaatagatactgctgatgcagatgtaacacatacgtcacacaatgtcttcaattcagaagttgtattaatataagctactactgtataatccggatactgtttttttaattctttcaattcttccacagaaagctgttctgccataggacatcctgcttcaccgctggaaagaagtactttcttgtctggtgagagaaccttcacggtttctgccataaaacggactccgcacataaggatcgtctgctcctgtgttttggcagcctgctggctcaatgcaaaggaatctcccatataatccgcaacttctaatatctcatgattttgataggcatgtgccagaatacatacttctttttctttttttaatctaaggatctcgtcctgaatttctcttgtcgtcatctttccctcttttatcacagaaaggctttcttcttccggtattcgttctgtcttaatgtgatctcatttttaatttgttttccaaacgacagtatcaataccggatctcactgccttttgctcactttagtaaaagtatacgatttgaaatatacactgtcaacacaaaaaatttacaggtgtcttgtcagttgtaaaattaagtgttatacttggagcaatctgtaaaaaaacactattttattaacataaaagaataggaaaagaatatgaaaacagatatacttatagttggaagtggctgttccggattatatgcagtcttaaatcttcctgaggaattagatattatgctgatcacgaagtctgattttgaaagcagtgattcctttttggctcagggaggcatgtgtacgttaaaagatccgtctgattatgacagcttttttgaggacacattaaaagccggacattatgagaatgaccagaagtctgtcgagatcatgatcaagtcttcccctgatgtagtgaaagatttggtaaaatacggtgtctcttttacccgggacgaaaatggtgattttgtctatacaagagaaggtgcacatgctcatcacagaatacttttccatgaagatatcactggaaaagagatcacaagccaccttttaaatgccgtcaaaaaattaaagaatgtaagaatgtatgaatatacgactctcttagatatcctttgcgatggcagcaagtgttgtggtggaattatcaggtggccggatggcagggaagaacaggttgaagctgactatgtaatacttgcaaccggcggtattggtggaacatacaagcattccactaatttcaaacacctgaccggtgacggcgtggagattgccagacgtcataatattgaactgaaaaatcttgattatgtccagattcatcctactactctttactctgataataaagaagaaagaagctttcttatttctgaatctgtaagaggtgaaggtgccaggctttatgataagaatatgaaccgttttgtagatgaactgttgccaagagatctgcttacacaggaaatctacaaacagatggagaaagacggcaccgattttgtgtgggaagatttaagaaccatcccgcgtgacgaattaataagtcattttccaaatattattgaacattgcagccaggccggttatgatgtgttccatgaatgtattcctatcgttccggctcagcattattttatgggcggaatcaaggtaaaccataacagtaaaacttctatggatcatctctacgcagtcggtgaaaccgcatgcaatggggttcatggaaaaaacagacttgcaagcaactcccttttagagagtcttgtatttgcaaaaagagcagcaaaagaaattgctggcgaaaggagataatatgtacgatcaggtaacattagggttaaatgtagacccatttatattaagtgctttaaaagaagatatcacaagtgaggacgtatccacaaacagtgttatgccacatccacagcagggcgaggtagacttgatctgcaaagaagatggcattatctgcggtcttcaggtttttgaaagaacctttactctgcttgattccaatacaaccgtagaattttttgtaaaagacggtgaccatgtaaaagccggtgaacttatgggcaaggttcatggtgatatccgtgtgcttctctgcggagagagaactgctcttaattaccttcagagaatgagtggaatcgcaacctatacaagccaggtggcaaagctccttgaaggaaccgggatcaagcttttagacacaagaaagactacaccgaacaaccgtatttttgaaaaatatgccgtgggagtcggtggcggaaataaccacagatacaacctttctgatggtgttcttctcaaggataaccatatcggagctgcaggtggtgtaaaagaagctgtcaaaatggctaaggcatatgcaccttttgtaagaaaaatcgaagttgaagttgaaacttttgaaatggtacaggatgccgtggaatcaggtgctgatattatcatgttagacaacatggataatgatcttttaaaacaatccatcgattatattgccggcagagctgaaatcgaaatttccggaaatgttaccaaagaaaacattgaaagaattaagaactttggtgtaaactatatatcaagtggtgctctgactcactcagctccaattatggatatttcacttaaaaatttacatgcagtttagaaaggactttgacagatgaacggagagatcaggagagcaaaaatagaaaatattttgaaatccagcgctgtgcctgtccctggagttactctggcaaaagacctggatgtaagcaggcagatcatcgtttcggacattgctcttcttcgtgcaaatggcctgacgatcctttccacaaacaaaggttatattattccaaaacaatccgcctgccagcgggtatttaaagtgatccatacagatgatcaggttggagaagaactctctctgatcgttgataatggcggtgttgtcaaagatgtttttgtttatcacaaggtttatggtgttatccgggctgatatgaatatccgtacaagacgcaatgtcaagaaatttttagaaggactctcttccggaagttccagccttcttaaaaatgtaaccggtggttatcattaccatacgattgaagctgaatccgaagagattttagatgatattcaaaatgaactcgcagaaaaaggttttctggccaaactgcaggattatgagcctgtagatttctggggcgaagaagaatcaaatacaaacgtttaatgcaatcaaggcgtcagtccggtatttccggaactgacgccttttaagcattggaaattgtcaatgccactgttttgtcttacatatacttcttcacaatattctccattactttccacttatgttccatatcagagacaagtttaaactgtgtccttgcccggtccaaattctgccccggtctgtgaattttaaaataaatgtctccctgaatataatccataagaaacctcattccacattcataggtcataagcctagcgcccatcggaagcagctttatctcttcctgtgaaagttttccaccacatccctctataaagcccttcgcacatgcttcaaaaagctctaaatcgcaccacactttatccagattttgttcatcctctaatgctgtacttgctccaatccgcaccgcatctccaaaatcattcatggctaccccaggcattacagtgtccaggtcaatcacacatattccttttttggtatccttatccatgaggacattattaatttttgtgtcattatgagtcacacgaaaactgattttcccacttctcagcaaatcctgaaagcagtccacaatttcttccctgtccaatacaaactgaatttcctcccggaccaaatccactctgctgcacacatcctcttccactgcctttttgaatgtctcaaatctttctctggtatcatgaaatcccggaattgtctcatgaagtgttttcgccggataatccgctaacatactttgaaatctgccaaatgccagaccgccctcataaagtatttcaggattatctatcaaatcatagcttacagtattttcaatgaatacataagctctccaatactcaccttccgagtccacgtaatagggtttcccgtcttttgcaggaatgacatttaatgtctccctctctggatttccaccgttagctgaaatttttctttttaaaaattcagtgactccaacgatattttccattaattcaaccgggtttttaaagatactcttgttcatctgctgtaaaatataatgcttttttactccctgctcgttttcaaatgtaacacggtaagtatcattaatatgtccatttccccatggaatttcttctttatatacaccttcaaaacagaagtttgcagccgcttctaattttccgcagagctgttttggataaaaatcattctcttccagctttttcactgctgccataaccattggtttatcttccctgtaggtaactccataccacttttctgttgtaagaagaacttttacttctgctttattgctatctaacagtctgctgacgaccgacggaagataatattcacatttcagtggattatgttgcagaccctcctgcagaaaatcacgaaatccatacgcaatctctgacaaaaatcccttgctaaatccccataaattcatggaaacaatcgtatctcctgccaaatccgtataactttttccatcatcttccgtatatgcagcattctctccacgttttacaatcgttgtatgttctgttacactgacaagttttccatcaccatcaatatcacagacacctcttgccacacttccattctccgtcaaagtatttttcaactgatatcctaccattgcatactgatacttttcattatcttcatgcacactcagataatcataaatctgcttaaatgcttctcttccataatagtcgtctgcattaatcactgcaaatggtccgtcaatcatatctttacagcttaaaattgcatgcgcagttccccatggctttactcttccggccggaacttcaaatccctccggcagattttccagctcctgaaatgcatatcttactttcataatcttttctatacgattccctatgacattatgaaaatcttccgcattctctctttttattacaaaaataacctcttcaaatcctgcaagataagcatcataaatagaaaaatcaacaataatatgtccatattcatctactggatcaatctgtttcattccaccgtaacggcttcccattccggctgccataattacaagtacaggtttcttcatattctttatacctcctgattaaacagcgtaccatttaatctcatttgcctctattttcaacgcaaaactgcttccatctccgcgatagataaccgtattctgtgactcgtaggtattatttacaacacagaatttgccattttttacatatgcatgtacttccacattgaaatttgtactaaaccactgatgtaataagttttcgccatgtgtactccacaaaatgcttcgataaagaattctgctgttctcaaagctatatggcagtccactgatatagaccgaacggccctcaccaaattcatgcacagccatctgaacttctttgtccctctgtaccagaatttctgttccctcatacgcaaacatattcttcttgccctctccgaagtcaacaggctttgttgtatctgcaagaataaagtgatttttgtgttcttcccagttatacttatcgtagtttaaggtaaatccggtttctttttccacaccaattaaatcagcaagctgcagataatgtccctgatactggtgtcctgccggttccccgacaccgataaatccaccgccccggtagacaaattcacgaatggctgcggaaataactgcattctcccagactgccccgccggtgtgtgccgtatccccgtccccgacattgataatgacatcaatatcctttaatatatccttatcctttaaaatatcatcaaatgaaataaatttcacatcaaacggtgcgccgcttaatgcctcgataattcccgcataactgtaattctgtttctgatataaggcatggtgtaccatatggcagccccagctgcggattttgccccagctgtttaaaacagcaaccttcttcacacagtatggtgttgttccttttgcattctcatatagttcacggaattcattgcacacgctctccacatagtccaaaaactccgggaaatctaatgcaagctttaaatatccgccatatccgatacggtcgattggttttcttaaaatggcacggcgtgctgtcacccagttttcctttgcttccttgacaggatctccgccctcatggaaggtatccgggaaaaagtatggaaggaatcttccttctgtatattttacaccttcaatatcagagatcagacgaagtgtacttccgtttccaacgcttcctaccactgcgtcaagaccgatcgttgcaaactcttccatgaatggttctgttccgatccagtgatcccccaaaaacatcattgcctctttgccgcattcatgtgtgatgtcaaccatctcttttgcaagctttgcaacttccctgcgctggaatgcctgaaaatccttatattctttaccaggtacacgatactgattgttataatatccctggtcaatgatatattccgggcggaatttataacccatttctttttcaaactgctctaaaatataaggacttactgacgcggaataaccataccaatccacatatttttcccgctttaactcgtcaaacatcaatgtaaactgatggaaaaacgtcgtatagcgaatgacattgacatatggatgctcctcgcagaatttacgcaggcgctccatggaatatttatgtgttttcggctgccgtacgtcaaacgtaatctgatgttcgaaatctttccagtcatttgtcaccgcattgtacatatgtaccggatcccagataatatatgccagaaagcttactgtatattcatgaaacggttctgcctcatgaatacagacgcaccctgactcctcattatattcccactgtttggtcgataccacctgacctgtggaacggtcaacaacctcccaccatcgtttaatatcatctcttgtattgacctgcattaactcatccgaaatccccttcatcagaggaatttgcagttcgctttcaacagccgtataaaatccactcataatataacactgctgcacctcatccgggttcgccttcgcccactcattatcttttctcgtggtgtagtaagttgcataaatctttgccccggtctttgtcagctcttccgggaattctgttccgtcacaatcgcggattgcatctgcaccccagcgtttcattaactcaattgtctctggaaccacatccagatttgtaggaattgtgacacgtcctgtatttttctcactcatttttcttcctcactctatttcatccatataattactttcttttcttcttttctgcaaaagggcaattataaatccacaatgccattaataaacagataattccaataagcataattcctaaacctgtcatttttcctgtcataccccatccaaaaacagacaggcttattccggcaataaaaagagctgccattaaaattattctgcattttgtgtgctttttccaaaattccattttaatctcccttctcatcaaccctttaaaccaccaacagtcattccctgtgtcagtttattctgaacacatatatataaaattaatgtaggaagcattactattacaagtcctgcatacataattccatactgtgctgctgactgctgtgcctgcatcagatttaataatcctaccggtaacgttttcggtccatttgccgaactcatcagtgtcatggaaatgatatattcattccaaaaagaaagaaaattaaacaagattactgtaataatagatggttttgccattgggaaaataattttccacatcgttgtactataacctgctccatcaatatatgccgcttcttcataatcatgtgccaatgttgaaaaataccctgacaacagataaattgtaaacggaagtgccgttgcagcatatacgattgcaagtatgaccagattatttaaaagaaaacttttcccaattactgatttcagccaattgtctccatctcgcagcatcagaaaaattggaacaacaatataattcacgttaataaaaagaccacccataaaagccgcatttaaaaatttgcttcctttaaatttaaaacgtgacaaacaataagctgccggcagtgcaacaattaaaagaattacaagtgccaaagctgtaacaaatgcggagtttaacatgtaatctcccatttttgctgtattccaggcatcaataaagttctgaaaataaaaaccctccggcaaagtccacggatttccataaaattctttattctgtttgatagatgccataaatacccatgctaccggaacaataatgatgactgcaagcaatattaaaactacataaataaaaattttatacaaatgctcggtagaattcgaatgtttcttctctttcatgttttttctccttaaaattccagtggttcccgctctgtaactttatttacaagtgcagataatgcaaatgagaaaatgaatatcacaacacctattgacatactatatccatataaacccgcatctttttgtccatacatataactcaatgccacttcagaagccccatttggtccgccagaagtcattgcttttacaaataaaaatgccatattaatcgtcgaaataataaagaatgtcagtgttgtgcgaatatttgtccaaatcagaggaattgtaatctgaaaaaactgaaccattcttccagccccatctaatccggcactttcataaaggctttccggtacgcttgccatagatgccatatacattaccatataataaccaatcgcctgccataccatggcaataataaggcttaccataacaagagactctcctttccataaaattggattttccattttatggaataagcttataatactatttaacattccgttctccggcttataaattgcagaaaaaatacctgcaattactacaaccgataaaatattgggaatataaaaaataatacggaaaaaattctgtcccctgattttttctcttgacagaatacccgcaaaaacaagtgcaaatgcaaaggtaactattgtaacaacaacaataagtaaaatcatgttttgcatggaccttataaaattagtatccgatattaatgttttaaaatttttcagaccaacaaatgcttcattcggtgaatatgcacccttttcaaataacgacattcggaatacatttaaggtaggcaatatcataaacacaaaaaataaaattactgcgggtgctatgcataccgccaaaaaaccgcttcgtcctctggcttttttcatactttcacgttcctttcaaacaaaccgtactatttaaaattcggcggacaaaaatcctgtccgccgactcatttttaccactatagcattaaggaaaactaaaaactcttatttcaaatttgcccgcatctggtcacttgccgaaataattccatcaatccactcctgctctgtcatatctcctgataccaaagagtttacagggtcaaagaatacagtacgtacttcaatacccggaattgcttcaaatgatgcaaaattgcccatggctgcctttgctccattatcatagatagaataaaacatgacattatcaccttctaatttatctgcaattcctaataccggctgaatagctcctgcttttgcaaaaatttcacatgctttatcactgtataaatatgagataaataattttgctgcatcctgatgttctgcaccagaaggaatccatgcctgttcaaaccatgtataactataactgtctcctcccgcttttaccgccggaagagctgtcataccccacttaaatccatctgcacgaggagcatctgccatttcaccgacaatccaggttccatttggcatgaaaattgccttattatcaagtactaactgctggttctgtgtaaaatcctgatcatttgcctgtgccggtgtaataggatttgtgtactcagctaactttgcaacaatatcaaaacatatctgtgcttctggtgtttcccagataccttcttcataatttgtggccttatcaaagaattcagatccgcctgcggcatacattaatgcatagaaaaatgcatcaaaatatcctgttgtcggatatgtaaataaataaattccctcttcttttgctttatctccaagttcccacatttcatcccaggttgttggaacatcccatcctttttcttctaaaagacctgcattataaaacagaccacatggggaataaaacattggtgcaagatatgtctttccatcaccataaggattcgtcaatgatgtatctgtaaatcctcctgcaatcttctctgaaacaagtttatcttctcccggaactttcatagataagacatctgtaatgtcagtaatcatatttcccttaataaactgttccgttaacgcagcttcacgtcccgtggccagatgaataacatccgggtattcgcctccctgcatggatggtcctattacatcctccaattttttatctgttgtaagttctacctgaattccggtttcttctgtaaatgcatctgtcacttcctgccacatttgcgaaccataacctgtctcaattgcggctacactgattgttgttcccgcataggctgcgtatggattatcagatgttggctgctctgccgcctctgttcctgtttcttctgttttgctgttatctgatgcagaagtctccgttcctgttcctgtgccgcaccccgcaaataaagatgctgccattaccatgctcatcattgtacacaaaatttttttcttcatagtaacctcccatttttgttaattttcactataaactcttgtgttttccttcttgcaattgttattatagcgtatattttttctttttcctatctatatattgctctttattttataattcttgctttattttaaaattcttgttattttgcttttttcattgtatactaagtacaacatcgttcctatcttaaacaggaaatcattgcaattataacatgaaaggactgtattttccatgagtaaccgcaaatttaatctggataatgaggtacagccggaaatccatttccgcctgctttccatatcagcatccaaatttgaaaatgactggacttcttttccccacagccatcattttacggaaatcttctttattaaagacggcaccggacgcatgctgatcgaaaatgaatctgttccggtctcctcaaacagccttgtcgtgatcggtgcgcaggtaacacacacagagttttccgatccggaaaatccactggattattatgtactcggggtggagggattaaaactgaataccgacaaagaaccggaatacattcatgtccctgcttccgcaaactcaccttttatccgccagtgttttgaaaacatcctgcgggaaatgcataacaaacaggaccgctacgcagagatctgtcagcattatctggatattttaattttatatttctgccggaaagaccatgtatcctatgaagtggtggatgcgcagaacagcagccatgaatgccacaaggtaaaacgctttatcgagcacaattaccagagcatgatctctctggattcgcttgccgaaaactgcagtctctcaaaatattacctttcacaccgttttgcagagctgtatggaaaatctcccatcgcttacctgaatgaagtgcggctggcgtctgcgcgtgacctgctgctcacaaccaatcacagtatcgaagagattgccggatgtatcggtttttcctctaccagctatttttcgcagtccttccagaaaaattttcatgaatcgccacagcagttccgcaaatcccaccgtgtcaggacatgaccatgtttcattttttacataaaaaagacggttttcctgcaaatgaaactgtcccaaaagaggcggcaccggaaatcccgatgccgcctctttcgataatgatttttatttaattataagaattttaccagtctatcttatacatattccttctgttgatcgcaccgatctcctccaaggtattgatcatgcgatacacggtcgcagtcccgatttttgaatcgatcctggatgctttgtaataaatttctttacagcttgagcaattctcattcagtatgatgtcgagcagcaccatcctctgctttgtgatcctgcatccctgctctttcagccgctgaatcacaatttcacgctgcatctgggttttctcatacttctgctgattttcgtcctgcttctgctgttcggatgtatgctgaatcatcttaaaccatgcccttcttaatcacctgaaatttgtgtttatcactatatctaatggcagcctctgcaatgtgaacagtccccaccgcaggaagattttccactctttttgtcccggacaatgcctctgacgatcagagcaactacggatatcaaaacaactaatacaacgaatgttcccatattatactaccgcctttctgtttttttaaggagaagcctctatgtatgaggcttcttcctgaaatgactattattttgcacttacaactttctttgcgtcaaccttcaaagagctgctctctttgtatgggcggaacagtaagtacaggaatccgatcacaagtaagaatgccacaactgttccgattccgaatgttccagttgtaattaatgtaccgatctggtagatgcaaagtgataccacataagcgagtccacactgatatccgattgcgaaccagaaccattttgcattgttcatctcacgtttgatcgctcccattgctgcaaagcatggtgcacacagtaagttgaataccaggaatccataagctgcgattggagtcatggctgctgcaaggttaccccagatctcagcaccatcttctgctacttctccgaatccatataacataccgaaagttgctacaacgttctcttttgcaatcaaaccagtgatcgctgcaactgccattttccatccttcacctgcttttgtccagccaagtggtgcaaagatccatgcgattgcgcttccgatagaagcaaggatagaattatttaactcctcaaccattccaaagcttccgctctcccatccaaagctcattaagaaccataatacgatggtagataaaagaatgatcgtacctgcttttttgatgaaggaccagcctctctcccacatgctgcggagtacgttagaaactgttggccagtggtatgccggaagctccataacgaatggtgcaggatcaccggcaaacatttttgttttctttaagatgataccggagcagatgattgctgcgataccaacgaaataacagcttgttgcgacccatccggagttatcgaagaacgcacctgcgatcatggcgataattggaagctttgctccacaaggaacaaaagttgttgtcataatggtcattttacggtcacggtcattctcgatggtacgggatgccataataccaggaacaccacatccgctgccgatcagcatcggaatgaaggattttccggaaagaccaaatttacggaagatacggtccatgatgaatgcaacacgtgccatatatccgcagctctctaagaaagcaaggaaaataaataatactaacatctgtggtacgaaaccaagaactgcaccgacaccggagatcacaccatctacgataagtcctgtcagccagtctgcacatccgatgccttcaaagaagctctgtgctcctggaatgatccattctgcaaataatgtgtcgtttgtccagtctgtcaataatgctccaacggttgtaacagatacataatatacaatgaacataacaagtgcgaaaataggtaatgctgcccatctgtttgtcacgatgcggtcaatcctgtcagaagttgtcagtttttctttggtgttctttgtcacacagtcgccaatgatagaagaaatgtatacgtatctctcatttgtgataacactctcggtatcatcatcaaatttatcttccatctctttaatctctgcggatacatccggaacgtttgtcatcatttcattgatcttatcatctttttccagtaatttgatcgcaaagaatctcttctgttcttccggcattcctttgatcttgccttcaacttctgcaataatatcctcagcctctttggagaactcgtgggctactactgctgcttttctgctctctgcaagcttcactgccttctcagctgcctctttgatgccggttccttttaaagcggaaatctcaacgacttcacagcctaattttttgcttaatttatctgtgtggattttctcaccgctcttctccacaacgtccatcatgttgactgccatgatgaccggaatacctaattccataagctgtgtggaaaggtaaaggttacgctcgatgtttgtaccgtcgacgatatttaagatcgcatccggtctctcagcgatgaggtagtttcttgcaactacttcctcaagtgtgtatggagataaagaatagatacccggtaagtccatgataacgacatctttatgtccttttaattttccttctttcttctctaccgtaacacccggccagttaccaacaaactggttggaacctgtcagagcattaaataatgttgttttaccgcagtttggatttcctgcgagtgcaattttaactgccatgatcaactctccttttctgcttctatgtaagtccgtttccatgtctggaatccgcatgccgcatcctgcaaaagtatgccagcactactcattttcataacatttttatcttttgagttagtcttatgtaacccatggacaaaaaaaattattccacttcgatcatctctgcatctgctttgcggagggataactcgtatccgcgcacagtaacctctatagggtcgccaagcggtgctacttttctgataaaaacatccacaccttttgtgatacccatatccatgatccttctcttaaccggtccctcgccagtcaactttttgacttttactgtctgtccgacagctatttcttttaatgtcatttcctaacggctccttttttattttttaatcatttatcagcaggcaggaaaacgccctgccattgcttacagcttacaggctggcacacctagaccatgatcttgtttgccatgtcttttccgatcgcaaccctcgaatccttgacattcacgatcatgttgccaccgatttcagatacgaccgtaaccacgcctccggttacaaatccgagattctctaaaaatcttctggtttcttcttttccgccaacttttttgattgtattctcttcacctgttttcaccattgttaaaggcatcatatcttcctcttccttatctttccaaagactattgataatctttttcgtttctacgttggttagtataatctaacgatagttagttgtcaataacttttttacatatttttctaaaatattttcttttgtagggctgcacaatttttcattattttaagtcactattttcagtgagatgtaaacctcctcagacgtatggtcatgaaaaaaaagaagacatcacacattttgctgtgcaatgccttcttccgcatcatttcttactgtttattctgcttattctgttttaactcttttttccatgccatatagcttgtgtactcttcactctttttgaacttgcgttttttcagaatgaacatcacaagtgagaggatgaatcctactacaccgatggtcgcaattgtctttaagatcacaagtaattttggctgtacaaatttaatggttgtattttcaccaacaccattcatagcaacagagtttgctaatacatacaggtcatggtggcatgcctcgcgcattgctgttaccataaccggatcatttttatatgccggtaattctttggtcacatacggcatcatggcatcataggttgtaacaccacctgccatcactccgtccgggccattgacatatggattaagaacgttgtctgtgatggtaagtccattgctgccccactcatttctcatgattccggtcatcaagcctttgttaccgccggaccagatacatccccaacgtgtgtaagcaaccatggttccgtttgcatttccttcttcaaacacatcctggaatgcttttaaatatacttcacgtgctgcctgttcagagagccatacgccaagaccgatacgatcctgctcgcagtcatttaatgcaaagtgtttcattacgacatgaacacctttttcctggatagctgccacttcgtaagcgctcatttttccggaaaggaatccatcttcactgtagtactcgaagttacgtccgccataaggatttctgtggatattgttacccggtccgtaaagaatcgcaacgcctgcagacagacagttattaccgatcactttaccaatttctgtcataatatccgtattgaaagttgctgccatcacatcctcagatgtaaatgcagttgctgtcagtttttctttatccgtattgccgaataaggaagcggtcaatccctgtggtccgttctcatcacgggaacccggagcctggatcgatttgatcggcattgtccagtggaaggagtcgccaattaaagttaccatctcgtcataggtaagctggtctaataaagtatcccagtcagcatcgtcataatctttgccgatcatatcgtataaagtaagaccatttttagcgcctaaagtcggcatctctacggtatcataatctgctgcatcgtactgtactaactgcagatcatcgatcattgtatctgtcaatgcaaataccggggactctgttgggaaagttccctcccagtcattacgtgaaaggtaagttacggagttatctccggcaccttcgtaaaggttcatatcagaatcagataactggtttgttacctctgcaccactcttggatactgcgtaagtagtggtatctaatgtatcatttgtccactggaatgtaagctctgcgttaccttctgcatccattccattctcagttgtgaatccttttgctgcaagaatgttatttacagcattgtgtgcatctgttgctgctgtgaaatagtaatcaccggcatctaagatatatgtttttgcaccatatgcatcataagatgcgatatctgctctgtccacattaattgttaatgtctgggactcacccggagccaaaatatcagttttgccaaatccgcataactgtactgcagatttctctacagaattttctttgtcatactctgtatatggagactgtgcgtaaatctgaacggtctcttttccggaataagtatcacctgtattggtgactgtcacattaaagttataagaatctgtcgcagcatcataaacacctgtcatgtcactgtactcgaaatctgtatagcttaatccataaccgaatgggaatgctacatcatcactgtatacatagcttcctgcatttccggttcccataaccgtgtcttcataacgtgtctcataatatttgtatccaacgtagataccttcctgatataccatgtagctttttgctttttcaggaatcagttcttctgaataaccttcataaatcatcggtgtgaagtttgccatggccggtgaagaataattgtcatagcagtaagtatccacaaggcttccggatggattgacgttacctgcaaggatatcagccactgcattgatacctgtaattccgacatcgccgatccacagacaggcatctacattataagtattgtcttttaagaaatctacctgtaatgcatttgcagagttgatcagcacaatgatcttgctcactgttccgtctgctttcattgctgccacattggaaagcatttctttttcattgtcatctaatgcaaggtaattgacatcgccgtatgcaaggtcggcaccctcaccgcctacacgggataatgtgacgattgccgcatcaccataagagcttacagaatctttcacttcgtctgtgtactcattccatggaacttcagttacaacggcacttgcagttgcgatcgtaccaccgtttccacgtttgtacattcccatctcttcggattcatagaagttccagagtgtttcgtttacattgaaacctgttttttccatcgcagtttttaaggtatctgctgtggaagcgtcaatgttaccggatcctgtaccaccatacacaaggtttacagatgaattggaaaacagactgacattgtccccttctgccagaggaagtgcgttattctcattcataagaagcgctgcaccttctgcctccacctgctggacaagctgtaatccgtagtcaaccatatcttctgtagactcaaagtcagaggtaaagtactgtgcactttcatcctcgttctgtaatttccagaatgttcctccgacgaaaatagccagtgaattatcaaaaacgtttaataaactgtacagcggcacaaagatcactgccagaatcgcacatacgatcgataatcctttccatggacggattgctctgtgttttgctttgcggaaagccttcttgcgggctttcacttcttttttgttctctcccataatttttctccatttcttttttcaaattccgtcattttgacgaactttgtttactttgtgttttcattttattaaaattttgttaaaaaatcaacaaacccgccctagtcggttctttttatgacgtaagtggtcatttgaattcttccggcacatcctcataagttttccatttttccatggcttcttccagtgacattccctcacttacagcgtgttttctcactgcattgacagcctggatctctttcattctggctcctgttaaagtgtagcctttcattgcccagagtgttgcaagccatgcgatcatcggaacaatacagaacagaatcagaacaactccatgcattccggaagaatatggtgtcttgctgtccggtaatgtctggataccgatcattgcaactgctgcaccaacgatggtagatccaagagaacttactaatttatctacaagtgagaacaatgttcccataattcccggcacatactgtccggaacggtatgtctcataatcggaacagtctgcaaccatcggaatcggcatatctgctgtcgcataatatgcaccataaccgataccaaagaataacacaaataacaccgtgtatacattgatggatctcaggcttaagttaaatgccggaaccccctgcttccataacagtaacaatactaaaactccaatgtacatgaccagcgcaagcattgtatagcgcaccagtgaagctttctgtccatgcttctgtgatgtttttactgtcaaaaggaagaacggaacagagaaaatatatccgacgatcatcatcggaagatacagtccgccgtagtctcccatcatcgctccgtaaagcatacagagtactgtcatattcgttgcaatggagaaagcgagcttgcatcccgctcctgcgaccataagacgctgcagctctttgtttgcttttaaaatagcaacatattcttttaattttactttttcctgtttattgccaacaccgaaaaattccggtctgtctttctcccagataccgatcactgcaagaagtgtcagcactgcagataccacgatggcaagcgggatcataaaatcaaaaaagtttgcgctgttatagccgccaagacggtcacctaagatcggtgccagaaactgtacaagtcccataccgatcaggctggcgatcgtattaaaaatagtaaacatcgggcgctgtttcggatcgtttgtcagacaagtctgtccggaacgggtacaggctgtctggaatgtgtatccgataacatataatgcataaaataacacaaaacatgcatagcgcagccactgcatgtccggtgcgatgatcctcgttccaaaatacagtaaaatggaagaaacgatcatgatcacatttccgattaccatgtatggacggaatttaccgaattttgaatttgtccggtcgatcaaagctccgatgattggatccgtcacggcatcaaaaagacgcataacggttaccattgtcgttgcaaacataagcgcaagtcctaacactccgtttgcataatatgcgataaaattcatggtaagaatataataaacatttgtcgcaccattgttcatcgggaacagcacaagctgatacggttttgcccggttcattccggctgcctgtgcagtggttttttctttttgattactcattatttcttctcctttggaatatcctgctaaaatctatacccagttttcactctttttcgcttcttttttcagcttataatccggattctctttttctgtgtgatgaagtaccatcgcatccttcacacttccggctacagcttcgatctgattctctttttccataggaagctggaaggtaaaaatatgatttccgctcttctgctcgatcagctctccgttattgtataaggatacgaccggctggtttgtgtaaactttaatggtcgttgtatcctcagaacggtcactgcggcgtgatccacacagatgtacaaatggttcgtcactccaatatgctttatataagaagaaactgtctttctttgtcttgcggtcaaatgtcacaagtcccttatggttcatgcccggctcgccgccctgatttctagcatctgccgcaaaatcaaacatattccacacataagtgctccacataaatggatgacgctcgaaacatttgatcatatactcatgatattttgcctgatattcctcagtatggtctccacgtctcggtcttctgctgtgaaggtttggcataccttccgcgccatactcggaataaccgatcgggcggttcgggaatacaaggtggaaaaatcttaagaacagatcatttaagaaaaatcccggtacataccatcccagatataaattccatccaaccagatctgtgatgtgtgcagaacggttaaatggtccgcacattgcataacatgctaacgttgtcagtcttgtcgggtccatcttgtggcaaagatcatttaacacatgatgattgtccaacatatcttttttgtcctttgtactgatggtaatctcattggatacgccccatactacaattgacggatgattgtaattctgaacgatcagctctctcatctggctgatggtgttctctcttccgcccggcatatgttccgaaatgtatggaatctctgcccatacgaccatacctctctcatcacagagatcataaaaatactggtcatgctgatagtgtgcgagacgaatcgtatttgccccaagttcgcagatcatatccatatcttcatcatggttttttgttgaaatcgcatttcctaatgctttaaaatcctgatgtctggaaactccgtgaagtggataatgctctccgtttaagaaaaatcccttctttggatctaccgaaaaagtacggataccaaaacggttcgtgatctcatccttcacttctccatttacggtcaacgttgcaactgccgtataaaggtatggattttttcttccatgccagcggattggattctggatattaagatttacgtcacatccgttcccttctgcaactacttttccgtcctgatctttgatctgaacgtttacctgtgcttcctctgtattggtaaatgtttcgatatgaacattcgcttcgttctcttttacttccggtgtgatcttaattccgttacttccgaggtaatctaagtcaaaatgctcttttgacacgatcaggaaacggacatcgcggtaaattccgccatagaacgtaaaatcggctttctgcggatatacttttccattgacggagttgtccacggtcacttccagtttattccggtcttctaaaacctctgtgatattgatgcggaatgtggaatatccgccatcatgatgtgcaagttcttttccgttcacagtcacatcactgcttgcatttacaccaagaaactccagatatacttcctctgcctccggatcaaattccggtttttcaaatgttttctcatagtggcaggttcctctgtagtaatcatttcctccgtcctgtccgtcttttgcattccatgtatgtggcaagttcacctgctcttgtctgttgtcaggtccaatgaaaagccactgctccatcagattttgaattcgtcgcatataacacatcctttttattatttatggtgcctgtcactttgtatcgtttcaggctatttttatatattgttccaatttcaatacataaataataaataaaattcgttaatttttcaacgaacctgacttagtcggtgctttttgtgacgtaagtggtgttcccttatttatttcaccgggagcagcacttccagattgaaacagttcatctctgtggatactgagatatcccccccgtatttctctgcaatgtgccggatactctttaacccaatcccgtgatactgcttgtttttcttcgtggtctttggcagatcattctcatactccggtgcccgctcgattggattcgaaaaacggatatataaaaaatgctgcttttctgcgacacagatatcgataaaccgcatctctttctctgaaaacttttccacacactcgatcgcattgtcaatagcatttccaaacagtgcataaatatcaatggaatccataaagaaaagcttctttccatcgatcacacagtgcatggtaatatctcttgcctcacagatcaggctcttctctgagagcaatgtatccagaatctcatttcctgtttttacgatagagtcgtaaatgcggattgactgttccagttcttttaaatttttctcccgctctgtcgggttttcaatatgccgcattgcagccacctgatacttcagatcgtgacatttgcggtcgatcacctgcatctggtctttcgcgatctcgtactgcttcttctgctggtaccacatgcgctccatcagcgcatactcctgctttacttcgctttttttgaaaagctctgcctgcagatacaaaaaagtcacgcaatataactgaaccagaaccgcaagattggattctccacggttctggtaaaaattgtagtaagaaaacaaggataagaaaagcactgctgctgctgagagtgttcttcttggtcctgcctggtaaaatccatttctcggaagccagcggaacagcgtgatggacaatagcagatacaccgctgcaaaaaacagaagtgaaaagagatattgcagcacccgcggctgctgctcaatggcagaaacgcgatgtagactgttccagataatattgatacaatgatatacaatgagcggccagaccgtacaataaatcatttcccagcttatttttttgctgatcagtccaacagcaatcatcgtgatcacaaaacgcatgaaaaactctgcgatcagatgttccccgattgccggaatgagcagtcttgctgcaagcatgacacaccaagccccacaaagtatcagaccgttttttatttttttcttttccatgacatgcaatggcatgagaaacagatacacacataccagcaataaaaaatcctgaaaaatcatgataccaaaatcacgaaccattcttaacttctccctacactgcggatgagtgccgtcataaagtttttcttactgcggcggctgatctgcagttcctctccttctacgatcaccgtgtcatccttaatctctgcaacatgtgtcagacctaccagacaccagttgctacattttgcaaacagcccctttggaagctcctcttccacatttttcaagcttccgcgcacctcaaaattgccctgttttgtgtgatagcgcaacacatgattctggatctccacataaaaaatgtctctggaatcaatctttttgacgccggttcccgtctggatcatcaccggtttgcttccgcggttctccaccagctgcatggcacgatccatcttattggcaaaattcaggtactggatcggctttaagacaaagtccagtgcgcccacttcatatcctttgattgcatagtgcgccatgttcgtaatgaacatgatgactacctgggcatcccttttacggatctgctctgccgcatccatgccgtttgttcccggcatctcaatgtccatcaggataatatcataatctccgttataaactgccagaaaatcatccgctttctcaaaaggtgtcgcctcaaatgctgtatcacgttcctgttcatattgttttatataaataaaaagtgtgtcacgataaccctgatcgtcttccacaattgctatcctgttcatgtctgctccatctttatgaatcctgcattttggcagtgttcttcactaccttcttttttccgtatctcttattataacaattcacatttgcagtgtctaggtttcgtatgcaaaaagattgatgagcccgccaaaaggtattgggcgacagcaaaatcccaccggcagataggatgttcctgttcgcttcgctcacgaaggaaatcatatctgccggtgggatttttctatcttgttgtatcgttgctgccatcatcttcgaggtcaaaatgtttgacaagcgcttcgagtgttgcagcctgtgcagccagctcctctgatgttgcagaagtctcctctgcagatgcagaattatcttccactgccttggagatttcttcgataccaagtttgatctgctcaatgttttgattctgcgtctggttattctctgcactcttccctatcataccattcacattttcaatcgcatccaatacttcctgcatggagacaaccacattcgctgcaagttctgttccacgctcaatctcctgaatggatactccaatgaggtctttcgtattatttgcagccttggaacttccttctgcaagcgatccaatctcagaagcaaccactgcaaatcccttaccggcttcaccggctcttgccgcctcaatcgaagcattcagtgccaaaagattcgtctgatctgctatgtcttcgattgtcttaatgatgctgacaacttcattggaagtctctgtgatcttgttcatcgcatctgtcatctgatccatctgcattctgctgtcctgcatcatctttgtgacacgtgccgtttcatctgctgattttaatgcatcgtctgtattctcttttacctgctcagatacagaaactgaagttgcgacaagttcttccacagaagctgcctgtgtgcttgcaccctcagcaatattctgggctgctctcgaaagatcatctgcaccagccgaaacctgtgcggaactgttgatgatattctcgatcattccctgtaatgattctgagatatgcatcattccatcttttacttttgcaaaatcacctgcataatcgtattttaatgtaaatttcagttttccatcggataaacggttcaggacatacgcaatctcatcaatataattaatgtattcttttaaccggtttacggtcttctggatggaatctgcaagttctccaatctcgttctctgaagaaacgtcgagcgatacatccagattaccctctgccagttcctgtgccacctcatttaatgcaacgatcggttttgtgatattgcctgccagacgtctgattgccataatgataatgacaactccaacaattacaagcagcagtacaataatgatacactggatcaggcttgctaaatattcgctggaaggcatacagcttaacgtataataatcggtcgttccgattcttccgacatatccatacttgctgcttccatctgctttatacttcacagatgttccgttctgactctgaattgctttcatcacggaatccgaaacgttcagctcggaaagatttttcaactggttatctgaattaggatgataaataatggttccatccgatgttactaaaataacaaatccattgtttccaatcttataagccgaaagcagttcatcaatatgctcaagtgcgatatccgctcctgcaacaccaatgatattcttgccattttcatcataaaccggagctgctgcacttaagatcagatttccggtactcgcctccacataagcacttgtcaggatcgtactgttcgtctccactgcacgataccaggtacgctctgtgatttcaaagctgctgtcacttgtaaacccgtctgactgtgtcgccacattagcatcaatatctccaagccagactgcctgaatgttatcactgtctgctgctgcaattttctccatctcgtgaaataccgtctgatagtctgccgactctgtgatcttatctcctgcttttgtctcagtaagcagtgtccgcacatctttgtcaagcgccatctgctccacaatggtcatatactcctgaaaaaagatttcaagctggtaagatgctgccttcgactgcatctccagatcattcttctgtgcacttaagctgacatttccaaccataactgcgaccacaaccgcaaccaccataaaaatcgcaatcacaatggtaagaatacggctctggatttcctgcgcaatccgctttttctttgttttcatatcaaatctcctctctggtttttctgacatcttctcgaaatgtaacaatctatttttattataatactctttctgccaaaagcaaacaaattcgggcattttcagaaatttttcgtcagtttgttttctcatcactccataaatgcgacagcggctggaaggtatatcccatgtcctcccatcttgtgagcagctcatctaaaattttaccattggtggatgatgtattatgtaacaatacaattgcgcccggatggatgcgtccgatcagttttccataagcctcctcctctgtcggctgtgcatccgcattccagtccacataggcgaggctccagaaaaaggtcttataccccaattcttttgccatcgcaagattctctgtactgtatttgccctgcggtggtctgtaatactttgtcatctcctgtccggtcacttcctgaaacaaactgctgactgcatcgagctctttctgaaacgactctttgtccgagattgccgacatatccggatgatgataggtgtgatttcccaccgtgtgtccctctgtaaccatccgtttgaccaattccggcgcactctccaaaaaatgtcccacgacaaaaaaagttcccggtgcattgtgttttttgagtgcatccagaattgctcctgtattgccattctcatagccgcagtcaaatgtgagatagatcaccttttcctctttacttcctatataataggtatcatactgctttaactcatccgccgtggcatttccggtcggctgcagttcctttccagactcgccaaagccaagtccccagttatcgactgccgcctcgatgtgcatcgtctcctctgtttccctgtcagactgccactttgccacgacggctgcgcttccccagccgaataaaaacatcactgcaaaaagcagcaggctggaacggtattttaataagaatgctttcattttctgctccgcatatcttctctttttatgtatacgaagccagacgttgtcctattcattttgtttataaccacagcgaggacacacaccaacgcccttatagatgtaaccgcaacggtaacagcaaatcgtatcgtgtttttcctttgcaagataagattcttttctggaaaatggtttttcctgcagatagcgcacaaaatcttctagcacctttgcaaatttttccatctcttcatgctccactgccagcggaagttttgtcttacttccattcttctgatacacataaatgccccggtttaatagtcctgtaacagcctggatagactcaatatccatcaccggaatgtaataggaagtcatccatgcgctgtagtaaaggttctctggtgtcagaagaaccccttcttttcctgactcatcctttgatttgtctaccagaagcaccggatactcaaactttccgattccgtttgcaaaattatccactgctccctcaaagacagctgtctcctccggttccgcctgcttctgccacactctttttgccggataaaaatgacaccgtttcgactctgtcacaccggcttcgacaaatgcattcagcaatttgctgactaaaagcccgcactcatccgttttaatcttggacatgcgctgctccagttcttttaatgcatcaaatttcaactgaggaaggaaatcgccatcctctaactgctttgctgcttcgctggcatcctcaaaatccatcctgccgacatctccgcagatttcctttatttttttctcatccatagcacgaatcctgttctccacttgttccgtgtacggtctgacaatatccggactgatgctttctttttttatgtcatccagcagagaaaccagttcctctcttgtttttcttcccggctggttgacaagccgctgcacctgcgtcagacgcttcaattcctcctggcgggcctgtctgtctctctcagcatttgtggatgtgtctgcactgcctgttgatgcggcatactttgatgcgtttccactgtctactgatgagccgtattttgatggaattctgctgtctgccggtattatatttccggatggattcttccttcctgttgttgacgcattttctgatgattttgtattttcaaccgattctgtcttcttttgtgggctcctctcaaatatctgctctgcatttcttgcacgccctgttttttcttttgcagattgcgtttcctctactgacgtaccgttggttttctctaccgtttttttctgtgttttgtctataaccttttctgtgctctgccgtggattttccttactgttttggttgttttcccacactgcgcccttattttcctgcgttttttctcttgcttttcctgtaattgcagaggaatcttctcttagtttttccacagttgttgtggcattttcttttgcttcttccagatttgcatgagatattccacttgattttcccgcagttacaggtgcgttttccctcggtttctccgaatctcttcccggctttccaaatgttctctcagagtttccatccgatttgtctacattttttttcgttttgcctgattcttctgcattacgttccaattctgtatccggctcatcttccgcggctctttccgtatctgcttccttctcatcatctgcgtcgcaatccgcatctgtttccatctcatcctcgccgcggattgcttgctccaaacgtcttacaccctcgtccgaataaaatccttcttccattttccgcagagtgtgaaacatttcctgctctgacacttccggcagatgctcgatcagttctgtaatttcctgttcctcatcctgtaacgaagatgcgtctgcacgttccatctccattgccatttttttgtccacatactcattgtattttgtattcacattccgtccggcagtacgtcccaaaagttcctgataatcctcataggcagcctcatcccgctcaaagtccattttgtatacatccccatccaccaacagacgctttggtcttggcgtatacatgcaacagcactttttacaactgtaaacgcgggcaatgcggactgccccctcttctgtctcaatctgaaattccctgccttccgggtaaactgccatgtaaagctggcttccacacttcgggcacagatatccggccagataaaagttatttccgatccggtttcgtctccgctctgcaagcgtggtatcccgcatcaaaaaactgctcgccgcctttttccagaccagcttatgccacaatccctgcggctcctcttcctccggcagtaaaacctcctcgggttcatctgacagcactgcctcgatcacgtcctcataggtcagacgaattttatttttatagaagcggaagtgttccggtccatactgcgattccacctgaaattccccaaggatctgcgcaaacaaccggttcagctgcacataatctttgtccacacggagtcccttgatatttccccactttccaaacgcataaagcaccatattcaaaatatccctcacatttgggtgctgctccacggcagcgatcatctgctcctctgccttcagctcgataatattcgtcaccacaagcttcgtgtcaaagttgaaaaaaagtgaacgcacactgccctgcaggatcagataatctccgaccacaaaaaacatgccgttccactccaccggcgcatccatcattttgatcaatttctgaaaagttaaattcaattctttatccgcttttaaaactatcatgttatcctccgttctcttgtggttattataccatgaacttcaattaagtttataaagtttttatatattctgtaaacaccttatttttctgctttcgcccgttcattgttagcactcatttaaaaagagtgctaattttctattgacttttgcagacaagggttataaaatcctagatataagttgaaatgcaatgattcagatatttgataagtgcattttataacagagtataaaataattagttttacttatggatagaaaaaggagtgttatattatggctgagaaacatggaaatctttcaatcaacagtgataaccttttcccgatcatcaagaaatggttatattccgatcacgatatcttctatcgtgaattgatcagtaatggctgcgatgccatcacaaaattaaaaaaactggatatgatgggcgagtacgaattacctgctgattacaaaccacagattcaggttattgtaaacccggacgaaaaaacgttaaaattcattgataatggtcttggtatgacatctgatgaagtagaggaatatatcaaccagatcgcattttccggtgctactgatttcatcgaaaaatacaaagacaaggcaaacgacgatcagatcatcggtcatttcggacttggtttctactctgcattcatggtagcggatcaggtgacgatcgatactttatcttataaaaaagatgccacacctgtccactgggcatgtgacggaggcacagaattcgatatgacagacggcacaaaagaaggtgtcggtactgagatcactttatatctgaatgaagactgtctcgaatttgcaaacgaataccgtgcaagagaagtcatcgagaagtactgctctttcatgccaaccccaattttcttatctaaggcaaatgctgagacagaatatgaaaccatcgatgcagcagataagttagatactgataccgttgtggaagaaatccacgaggaagcaaaaacagaggaaaaagaaaatgaaaacggtgaaaaagaagtcgttgaagtttcccctgcaaaagaaaaattaaaaattgtaaaacgtccggttccattgaacgataccaacccattgtgggcaaagaatccaaaagactgcacagacgaagaatacaaggaattttaccgcaaagtattcttagactacaaagagcctctgttctggatccacctgaacatggactatccgttcaacttaaaaggaattttatacttcccgaagatcaatacagaatacgattctattgagggaaccattaagttatataacaatcaggtgttcatcgcagataacatcaaagaagtcattcctgaattcttaatgttattaaaaggtgtgatcgactgtccggatcttccactgaacgtatcccgttccgctttacagaacgatggcttcgtaaagaagatctccgaatatatcaccaagaaagttgcggacaaactcatcggcatgtgcaagaccgaaaaggaaagctatgagaaatactgggatgacatcagcccgttcatcaaatttggctgcttaaaggatacaaagttctgtgacaagatgaacgactacatcctgttcaaaaacttagatgacaagtatctgactcttccggaattattagtgaaggaagaagaaaagaaagacgatgcggaggtattagacaaagatggtaatccaattacaaacactggcgatgctgctgcatctgataatactgctgatggcagcgacacttctgctgacagcgaaaaagatgaacgtaaagttatctactatgttaccgataaagtccagcagggtcagtacattaagctcttcaaagaacagaacatgcaggcagtgatcttagatcacaacattgatacctctttcatcacacagttagagcagcgcaatgaaaaatacaaattcatgcgtattgatgcggatgtgacagaatccttaaaggatgagacttctgcagaagatctgaaagctgagacagatgctttgacagaagtattcaaaaaagctctgaacaacgataaactcactgtgaaagtggagaagctgaaaaatgagaacatctcttctatcatcacactttccgaagaaggaagacgtatgcaggatatgatgaagatgtatgccatgaacggtatgggcggcatggacatgaatatgtttgctgctgaccagacacttactttaaatgctaacaacgaacttgtaaaatacattttcgagcacaaagattccgagaacgttccgatgttctgcgagcagttatacgatctggctgtgctctccaaccatccgttatctgtagatgagatgacaaaattcgtggagcgcagcaataaaatcatgatgctgctggcaaaataaatcgaaatataccggagtttagccaacgtagtgtcgcagattctgcagtgcttttatgggttgtgaggggcagatataagcgccctctcacaaggcaaatttatatgtaatgaaaaagaaaaatggtataaacgaaatattatgtttctgttcgccgggcattacgatgggcttctgaacaacaatcatgttcagcaaaggcttccatgattgttagaagcccatctccatggctcacaaagaaaataatatttgtttataccgtttttctttcatttacgttatgagtgacttgtgggagaacgcttatacatgtccaatttacgctgtgaattgcaccacaaaatctgcaatttacgttatggaactcacggttatgggatgagtgcctattggataacgacagaaatcaatctgtattcccatcataatttaagttcaacttcttcaaatgaattttcatagaatcaaatagattttcaaatttaattatgatagaatcatggtgttaatgagtttgacaaatcatatttacatgaacaagtgaatgattgaaattacagaggagaacaaatagatgatttccattgataccaaaagactccatcttcggaatgtattgcaaaatgatgtggatgtaatatttgattatagaaataatgaaatatgtgatcgatatcagagaggacaggtaaaagactatgaaggaattgtaagtttgattgaacgccgaagaaatgatgagatatcaattgattttccttgtatgatagcagtagcactaaaggatacaaatgaaatgattggtgaaatagttgttatgccaaaggatcatacattttctctcggatataccttttcttataaatatcatcgacaaggatatgcttttgaagccttaactgttttgactgaacatcttcacaagatggcttcggaatgggagtttattagttttacagaatgtgaaaatatagctagtattgaattgcttaagaaattaggatataagaatcttggctatgttccaagtctggattctcaagcattcggcaaatggactacaatggacacggaggaagaatttgctcatctgggcaaataacttctggtcgcctaaacacttattaccacaatacaacagaataacccacactgtgtcagagtatatagaaaaaaatcagcggcagatgcctccacggtcactgctgcaggaaaaggatggataaaactatgaaatttatttcctggaatgtaaacggacttcgtgcctgcatgcaaaaaggatttttagattttttcaatgaagtggatgcagattttttctgtgtccaggaaacaaaattacaggaagggcagattgcccttgatctccccggctaccatcagttctggaattacgccgaaaaaaaaggctattccggcactgccatttttacaaaacacgaaccactctctgtctcttatggcatcggcatcccggagcatgaccatgaggggcgtgtcatcacattggaatacgatgctttttatctggttacctgttacactccgaattcccagaacgaactggcaagacttccttaccgcatgcagtgggaagaagattttcttgcctttctgaaaaggctcgacgaggtaaaacctgtcattgtctgtggagatctgaatgttgcacatgaagagatcgatttgaaaaatccaaaaaccaaccgcaaaaatgccggtttttccgatgaggaacgtgcaaagatgaccactctgttaaactctggattcacagatactttccgctatttttatccggataaagagggcatctactcctggtggtcttaccggttcaaggctcgtgagaagaacgctggatggcgtattgactattttatcacttccagatgtcttgacgaaaagctgcagtctgccggaatccatacggaagtgtacggctctgaccattgtccggtggaacttgttgcagacgtctgatgcagcgataatatgtgttttaacgtcatttcacataagaaaaaaagaaagaacgtaatccgctctttctttttttctctttcagactttttctatgattcttcactactatctgtttttcctgtatctctttcctgctgcaaacagcgcaccgcatcctgcacagagaatgagcgtccataccatccacatggaactgtctcctgtttttggcgatctgcctgtcagagtgatattcacatcctcatataccaaggcataggttgagaaaccatctgttgcaaatgtaaactgatttgtggctgcatcgtaagttccatcgatcagtgttgccacaccatcatggattctgacgatcctgtaaatgcgttcaatactgctgtcatggttcacaaggttctgcggaattgtgattgctatatacattggtgcggataaatccgtaatctggcgatcctcccttcctgatattttgaatgttaaattaagatttaagcattgtccgatcacattgtttccaagaacactctgaatgagtgcaatctcttcttttgttggtgtcatgccggatgcgctcaaaacaaactgcgtcttgtttccggcttttactgccttgttctcgtcttcacttaactttgcaagattcagcagctgatccgttgcacttgcgatattgattgcagggactccctctccgcttactgactgtgcagttatcgcattatctgtagatcccgcagccgaagaagcagttgtggaagatgtattggaactgttttccgtttttgcattaccattatccgctttctttgctgttttcacaataaaataagttgagaactgatttgtctcaaaagtcagcgtaccatcttccgacatagacgttgtaagttttgtgaggtttccgttatgctcccttacaacctcatatcctgccgccgtgtcataatcagccacttttagtttcattttcacaggctggctgaactgcgtgactggagtctcccagctatttccatttcccttgctgacaatctggtctaaagtcaggtttactgcttctgcacttactgcatttgctacctgtgcaagtgcatttgttgtatcttcattcgagtcagccacagtaagacgcagatttccacttggagctgcgtttgctccattttcaaaagaagcagaagatacttttgttgctgatgtattaatttcatccgatgtctgtgtgaagattcctttaaaatgcacgttggtatccggcattttgaaagtgaaggttgatacctccgtctgtggtgccaacgtaactccattgatggaagcccctgacaactgataaccataatccgggatcaacttaatggtaacaacatcatctctttttaccgcaagatgccctccgcttttatctcccggattatttgcgaaattagaaaatgtcatttgcgacacatcttgaccattgattttaataatttccgctgttccatgttcgatcctgccatcttccccataggtatcatcatacgcccatgtaacagtcaggcattttcgatcgatctggatatgctgagtaccatttaccgtgatagcagtatcttcactggttcctacggcctgcgttgctccgtgaaactgtatcttatactcatccttcttttccagctgtgcatatatggatacagatgtaaccgattcatccaataagcaaaccattccactctcatcaaatgttgctttattttgatttaacagatctgtaagcgtaacaaacccggtattatctggatttacatataattccagtcctgcatataatttcatgttctgatacgaactccatgcatttccttcaaactgcaagcttccccctgttggctgtggcggattgccaccctgacttccaccacctgcggaagtgtctgtaaactcaatatgaccgcctgtaatttcaatcggaacaccatctttcacttctacgccgtttggaattgccgccttataagtgctaccttgtgcataagtaattttaatatatacattctcaccctgaatggtatatttagactttccctgattatcagacgctgtcagctccgatatttctttccactcagcacttgtactgttatcacgataatttgtagaatattggattgtaccatatttatttttgtaagtatcatcataagtcccattatccaatgtaatctctacagaattaccgcttccttgtcctccttcatcctctgccgacacattcatccccggcaggacaccgaatatcagtaccaatgtcagcaggacactgactgctttcttccacgcctttctcatctgcttttcctcctatactacttttttgtgcaattttgttctcccattttgggactcttctctacacttttccgcttccgccacataccgtacatttcttcgctccatgacagagaatacaatcatccgtgatcacacccttgccatgacaaatagaacacgtctttcttcagaactctgttcggtcgctgcgatcgtctgatcactcacttcttttccacaggaagttacagtaaacaacatcaccgcaagacaaaaaaagactcccagatcacgcaccttatgtctcattcaagcctcctatctccataaaaggaatatacttgaaaaatcttaacataaaattgcacgatccgggagtttacatatgtctcaatcgtcacgatcagcctttttttccagtttccatgtataataaaactggatcaggccaatccttgaatttgtatctgtttttttgttgagcgatgaaatatatcgatataacattgccctcgaaatataaagcctatttgcgatctcctgcacctcctcatccgatgccaaaagcattttcaacacctcctgctcccgttctgtcagcgcataggtatctgcaaatgctgaaaaataatcctgctcctcttcctgtttccgctcctgatcaggcaattccacatccgtctgtcccatcaccgtgtaaatataaatcgcaatgctgatcagcacaaataacccgatcgatgcgatcatgatcttcgtactgtcgccggaccggatcagtgctactgaaaaacttccaatgagtatggcgcagagattgttcactgctcttcccatgccagcccaaaactgcggcactctcatataccccgccagccgcacaaaaccggtcgagaaaaacacaacaaagaagcctgccgacagataaaatacgatcagcccaagcaaaaaagagccgccggaaacgatcacaagtatacacaccgtggaaagcagcgtcacgcagtacatgataaggttcctatatctgccttttccataatcaaacaatacgcctgacacaagtccgctgaccgccaggatcagtcttggccactgtccgatatccatacttccacctgcatgccctaatgtcactgcattgtctaatgttgcaaaaatacaggtcataagggcgattgtgaaaatgagcgtacctgccgctgcatacggatgtctgatgggatctgactcatatagattccgctccatcaggctttctgccaccttccttttctccaccagaaaaagaagtgcccagaatgccacagtcaaaatcactgcttccaccgctgcattatggatcagattgttttcgagaaactgtaaaaaaagtccagttgcatacgatacccccaccgtttccgccagatgttcttccataccatagcggcacgctgcccggtagtgtaccagacttccggctattccaagcagcacatataaaatcagtcctgctgcaagtatgcttccataactctgatgtacctggatcccccaaagacatacagccgcgaggactccggcaccagcactgcctgccttctttgctctttcccgcagtttaccatccagtatgccaaacagaagaaaaccaaccgtactgcttccgagcacataactctgtgccagcaccactccacctgaatccgtctgaaatgccatcatattgtcaaataaatattctgctcccagaaacacataattaaataacgccagagcaatcatgatctcaattcgttctctcttccagaaagtattcttcatttgttaattctgcctttaatttttataagatttttccataagattccgtacagaatttcagatgatgattccaccaccggcaacataatcgccatcgtaaagcacaaccgcctgtcccggtgtcactgcacgtaccggttcttcaaatacacaatggatctgatcttctccggtacgtgtcactttacacatacttccactgtgggagtagcggatttttgcctttaacttcacttcgccttcaatgtctgggatcgacatgaagttcacatgatccgcatacagttctgtcgtaaacacatcctcattcgaacctaatacaacctcatttgtctccgggcggatctctgtcacaaacaccgggtaaccaagtgcaattccaagaccttttctctgtcctaccgtgtaatgtgtgattcctttatgtctgccaagtattttcccatctttggatacaaaatttccaggtggtggtacaagatttccacactctttatcaataaatcctgcataatcatcatctggaataaagcaaatctccatactgtcctttttgtgtgcaaccatcagcccgatttcttctgcaatctggcggatttcgtccttatggtaatctccgaccggcatgagtgttctcgataactgtgcctgtgtcagattgtaaagcgcataagtctggtcttttgcagctgtgacagaatttttgattgcatagcggccatttggaagctgctcaattcgtgcgtagtgtccggtcgcaatgtaatctgcaccaatagcaaggctccggtctaataatgcctcccacttcacatagcggttacatgcgatacatggattcggcgtccttcccttcagatattctgctgtaaaataatccatgacattctttttgaattcctgcttaaaattcatgacgtaatacggaatttccagacggtctgccactcttcgtgcatcatcaacagcactgagtccacagcagccaccatttttttcctgtgtaaattcatcctcgtcctgccagatctgcatggttacaccgatcacatcgtacccttgcttctttaacaaatatgctgcaacggaagaatccacgcctcccgacattcctactactactttttttgccatagtttacctcttttcccgccataaaaaaattatgagaaacccatttttcatgagcttctcataacatatcatgtctttatttattttgcaactgcttaggttgtggtattatagatttctccagttgtataattgtatgtatacaagcctgacttattgtaagtgttggctttctctgcctcactcttcgcataactctcaatcatacccgcctgaaccgatgtctggtaaccaaatccaccagtcgtatggaataaggatttcactgtgttcatatctgctttcttaaatgctgtctcatcaatggaaagcttattgtcggttccgatcgtgattccgaccttgctgagcatgttggaatttgcctttgtcagattgaccatggactttgtacttcttaagatgttgttggtattggaatccccaccctcttttaacatcttgttgtagctgtccacaaaatcactgactgccttgtaaatcttgtctgtatcatactcataagatacttttccatctttatctgtcgtctgtttctttgtaaacagagatttatctccgtttgttctcagtgtctcagatactttcttcaaatcatctgcagcgctctcgatatttgcaagtgtcttcgaagaatctttggaagtcgatgtagcagcagacacagacgaagatgatgaatcatccgatgccgcctttttgtaataagccttcatcagctttgtgtaacttccattccggatcgtagcatagtcagaataattaatgccaagtaaatctgatgttccaaacattgtacttgtattcgtccttcctgaattcaggctggaaaacagtacgccgatggaagatgaatcatatcctgaaattgttgccatatttctcactcctttgatcagcagtcatccgtgtaaaacaatatcgctgtgtaatcatgcatttcctctcatgattaccttctttaattattacatcgtcattttagcttcattttattagtttttcaagaccatttctgtagttttgcacaaaaatttataattattcaacaattgttcatactttattcacatattactgttacaatgaactcataaatgaaacggaaataagtttttaatacttgataaattttttcataatagcccagatgcctttggtatctgggcactcctcatttcagaggttttttcagatggcagaacaccatctgtttttttatatattctcaatctgccagtcaatcggttccacaccattcgcctgtaaaaactcatttgccttgctgaaatgcctgcatccgaaaaatccccggtacgcagacagtggacttggatgcggcgctgtcaggatcagatgctttggattggtcagcatcggtatcttgctctgtgccggtcttccccacagcatgtatacaatcggtctgtcctgtgcattcacagcctggatgattgcatccgtaaactgttcccagccatgcccctgatgggagtttgcctgatgtgcacgcacagtcagtactgtatttaacaaaagcacaccctgatctgcccattttttcaaatatccattattcgggatataacagccgagatcatcatgcagttccttatagatattctgtaaggaaggcggtatttctttctgctccggtaatacggaaaaagataatccgtgcgcctgatttacattatgatatggatcctgcccaagcaaaagcacttttaccttgcttaacggcgtaaaatgcatcgcattaaaaatatcgtccgctggcggataaatcaccgttttactgtattcatcgcggacaaactgatataacgctttataatatggctttttgaattccccctggatctcatccagccagtcatttgtgatcattgacatttttgttaccttcttaaaatttctcctgcactgctgcatttgtccgggacatccagtctgctgccggatgtctcagcgccgcaccggaacaccgcggtctgcaagataatctttcagatcagctatttccagctctttataatggaacagagaagctgctaacgctgcgtctgcttttccttctgtcagtgcatcataaaaatgctcttttgttccggctccaccggatgcgatcaccggaattgatacattctcagagatcattctggtgagttccagatcatagcctgccttagtgccatcacagtccatactggtcagtaaaatctcacccgcccccagccggtctgctttcatcgcccattcaaccgcatccatgccggcatcgatacggccgccatttttataaatattccagccgaatccatcttctctccgtcttgcatcgattgctacaacgacacactggctgccaaatttatctgctgcctcactgatcaggttcgggttattgatagcagacgagttgatggagatcttatctgctccctcgcggagcaacgccttaaaatcatctaccgtgcggattcctccacccacggtaaacgggataaagaccttttctgcgaccttccgcaccatatcgaccacagtctcccgcgcatcagacgttgctgtgatgtctaaaaatactaattcatctgctcctgctttatcatacgctgccgcaatctcaaccggatcacctgcatcccgtaagttgacaaaattaacaccttttaccacgcgtccctgatttacatcgagacatggaatgattctttttgtaaacattgacgtcctcctacaattgtgcaaagttagaaagtatctgtaatcctactgttccacttttttccggatggaactggcatgcaaaaatattatctttctccacagacgcatggatatgtgtgctgtaatcgatggttgctttgacaattgcctcttctctggcttttaaataataggaatggacaaaataaacaaacggactgccttccagattttgaaacagtcttccattgttctgcagatccagcgaattccatccaatatttggaattttcagtccttcctgttccgggattcgaaggatttctccatccaacagatgtaacccttccactccctcagactcttcacttccttcaaacaaaagctgtaatcccagacagattcccaaaaatggtttctgttctgccgccacttcatgaatgaccttatcaagttcaaacttcttcaactgactcatggcatctccgaaagatccaacacccggaaggatcactttgtctgcctttttgatctcatgaaaagctcttgtgatcacgcactcctgcccaagaaactgtaacgccttttctacgctttttaaatttcctgcatcatagtcaatgattgctatcattctgtcacctctgataagcctgccttctctaatactttataaatttctctggaataagtctctttattggacagtgcatacatggttcttgcatcctctgctgtcaatccaaaatcctgctgtaatgctgtctctgctgcactttcaatcttatcaaactcgcccctgcatccataagtctctgcatcctgcagatacttgtcatatcgctgcaccgtgcggatcagagaatccagagccatatcgtaaacctctgcatccatcatgctctcgtaagcttcatactctgctgaaaccatagctgtaatacgatatttctcataggtatccgtgtctttttcctttactttctcccctgccacagcctgaaaagcatccgaatatcttccttctgcaaatgcctggtctgcatctgcaaaactgtttgaatatccaagtaaatgtgtgcctgccagaacaagtaccagaatggatgctgccatcacaaaaacgaggatcaccggcacttttggcagcggcggtgtgttatccggttctgccggtggctttggtttcttctctttctttggttttacttttttctctttcggctgctttggtgctttttctttcttctttttctcttttttctttttttcttttttgcccttcttatcatcgtccgaagaaccttctaactcttttaagatgtccatatcatccatagacatctcagtaactgcaggttcagcctgcattccggaaatttcttcctcatctggttcatcatcaccgaacagtaatttagacagctttgccagaaatccctgtttcttcggcttcttttcttcttttcccccgtcatccggctgcacttctgcttttgcattgtctgcctccggtatttcggaatcttcgcctgttccactcagaatcctcattaattcatcatcttcatccgataccgctttttcgttttctgtttccggatcatccagtccaaaatcatcaattccgatatcatcgattgccagatcatcaattccatcttcactggcaccctcatcattttttacttcggcagtatcctctttctgctctgctgttttctccactgctgatgtttccatctctgctgtatcatttgcggcttcctgattcacgctctccatgatctggtcaatatcatcaagcatcggctgtgttgcttttgtcacaccctgtgaactttcgtccctgtctaattcttgctcgaactgttttaaaaattcatcgggatcattatctttccggagttcctgttcaaactgatccataaacagatcattggaatccggaatatcaattgtctctcttgtactcttctgtggcatttgttctttactctcaatttcttctggatttacaggatcactgtcatttaaatcagatctgccatcgacggcatttaataactgatccaggtaattttctgattcattcatggtaatattctcctgctattgatttctttgtaactatcatatatttatttttcgattatagtaaatcagggatgtgaaaaaactcacacccctttttctgacttaatctacgctcttatcgatcagattgtcaattgcctctaccagcataccgatctccggctttgtcaactgggcatctgctcctaactgttctccctttttgcgcatctcctcattcacaagagatgaaaaaataataagtggtatcttcttgatctcatcatctgatttgcagagttttgtcaatctgtgtccatccatgagaggcatctcaatatctgtgatgatacagtgtacgtcctgacggactgttcctttattcttgaactcagtcagcttatcccacgcctcctgtccgttcattgtcatgatcagattcgtgtatcctgattttttcagacactctgagatcatttttccaagcagtggggaatcctctgcaatgaggattggagaatcgcttctgtctctggctgttctatcctccacatctgatactttcagtccggtttccgggctgatgtccgtaactatcttttcaaaatcaaggatcaccactaattttccttccagcttgataacccctgttgcagcactcttatcttccgtgttgatcgtagaatccggtttaatgatgtcctcccatgatactctgtggataccgatcacttcatctacatggaatgcaatgtttaatttattaaagtttgtgataatgaataagccctttttctcggatggttccattcccagacactttttcaggtcaataaccgtcatcatcgtatcacgcggcataaaaattccttccacacaaggatgtgcatttggaaccggtgttacctgctgataggtaaggatctccctgatctttgccacgttgattccataataattgtcacctaacgtaaattccagaacttctaattcatttgtacctgactctaaaagaatatttgtatccattgtgtcttcctcccacgtatatgttctcttgttttttaattcgattggttttcattatatatgaacctcagtccgcagtgcacgccagaaaaatcagagattttcctggctgtcgggcattcgccctatcactctcgatatatacagacctcaccatgcaagcatgtccggtctgtatattctcggttggcactgctcattgcttacgcacattatatcatgaagcaaagcttcatgatcgttatctacactcgcttcgctcggcagtctttattatatcataactcttcctatttttacaattttatttcataagttgtgtcatctcttgtcacatggagcacaatatcagaaacttctgtcacggaatccggtatctcaaataaaagaaccgctgattttgtttctcccgccgggatctcatcatcataagttgaaaaatccgttgtcatgatcgttgtataagcagaaacctgcgtactctctgctccatccgcagaataatccgctgtaaactttacctttgaagtgagattatccagagtaataccctcttctgtaggattggtcatatcgatttcaagtgccataaactgttttccattcgaggctcttacatcaagcacttccgactctgtatagtttccggcaaggcttactcctccataggcaacttccagtccatccgctccaaatacatcctccagcgtatttccggctggtgtctcatccattatttctgtgccatccacactctcactgcctgtgacagtttcttccggctctgtttcttccacgctctgatccacatagaccagaccatccttctgatatgaattatgcttggaaacaacgtgtactgcataattgacgatctgactttcctctgcctctgtgagatcatatgctttcgttccacatcctgtcagcaaaagcatacctgtcagacataagattccttctatcttttttcttctcatactgtatcatcctccgcctgtccggaaccaatccctgttttttccgtgtcaagttcgaaccagaattctacgccatcttcatgatttaacacgccacattccctgtgaaatgactccatgattgcctttacgatagaaagtcctattccacttccaccatattccctcgttcttgccttgtccactttataaaacttgatccagacattatcaagatcttcttccggaatctgttttccggtattgaatacactcacccggacaacactgtcttttcttgtgtaccagattctgatcttcttatcaaattctgcatggtggatcgcattgctcagataatttgtcacaacctcttccaccttgaattcatctccccatgcatccatcggttcactctcatcaaatgtaaccgaaatatcgttctgctctaataaaatagaagatgaattaataattccatgaatcagttctgtcagattaaagcgttccattggaacaacttcatttccaaactctaactggtttaaagtcagaagttttttgaccatctgattcattttatccgcctcgtccatgatcacttcacagtagaaatcacggctctgtgcatcatcattgatacacgcctgcaatccctctgcatatccctggatcaacgccagcggtgtcttcagctcatgagatacattggatagaaactccttgcgcatctcatcgatttctgtttttttctcaatatcctgttttaattcgttatttgcactcttaagttctgagattgtgctttcaagcgcacatgacaaccggttaaaatgttcaccgagttcatctatctcattttttctgtgtcctttggaaacatacttggcatcaaaatcaagttctgtcattctttttgatatgtccgtgagttctgagatcggtgttgttatcctcttagacacaaacactgtgacaatcgcactgatcgcaattgccagaacgcccacgtaaaccagaaactgatttgaaatttttgcactctcacggatactctccactgcggtacgcatcaggatcagatttccattggaaagtgttccataaagaaccatgtactcagatgataaccttgtatctgtctgtttctgtatgacgtaattgtctgatctctgtaagatctcggtctggtttctgtcatcaccaaacaaaatattcataaattccatcagaatgacctgattgtcattcaccgacgacctcacgatcgcacggttggaactgatgatcataactgcaatattaccattggcacacagattgtcaaaagtgacatcaaactcactggaattcagttcacctgtctcactggcaccgttgatcacatcatatccgtcgatcagcgaatcctgcttattcaacatataatatttttccaaaaaggaagtattgataaaccagcataacataatcgtccctgctacaagtccgactaatatcactgcaagttcgcgggtcagtgacccttttttatctcttttcatattatgacaaccatcctgtaatgtcaatcagttttgcaaataatcgtcaataccctactccactataaacttgtagccaacaccccagattgtcttgatatactcccctttttccccgattttggcacggagttttttgacatgtgtgtcaattgtccttgcatctccaaagtaatcataattccacacgttgttcaatatcttttcacgggatagtgcaattccctgattctccataaaatagtccagcagttcaaattctttaatacttaattcgatcggtctgccatccacggtcacaagatgcgccgtcttatccagtttaataccgcccgcctcaacaaatttttcatcatttccggcagtcagtccgcttctgcgaagcagtgcatttacccttgccacaaggattttcggtgaaaatggtttggaaatgtattcgtccactccaagttcaaatccggtcagttcatcgctctcatcgctttttgcagtcagcataatgatcggaactttggatgtttcacgcacttcacggcagacatcccatccgttgatctttggcatcatgacgtctaaaataatcagtgcgatattcttttctttataaaatatatccagtgcctcctcaccgtctccggcctccagcacctcatagtcttccctcaccaaaaagtcgcggaccagtttacgcatcctgctctcatcatctactacaagaatctttaatctctccatatcgtcctccggttacgtctgttctctgttaaaaatatcacgattttatggctaatctgtgaaatctgtctgttctgtatccacctggatcccaagttcctgttctttttcgctcactgccttttcccgctccgtcagttcctgctcccaggatgcataacggtttaaaagtttcgactgatagtccacgatcgtcggactgtcgctcgtcagtgtcatggcaaacattgccacaacgcacaccacaaggattgcattcacacacagggaaatcttcaattttccggaggactctgtctctaatgccttcctgtcgatctttgcaagatttttttcacgctgtctcgccctgaccgcccgcacacgttccttctgtgcgatctcacgcttctgcttttttaagctttcctcaagtctcggatgtgtgaccggaatcggcaggatatcttcatttttgataaaaggaattgtcgtcaggtattcctgcagatcctttaaataactgtatccgactgctgtttcaaacagtttctgtccgatcattttgttataaacctgcaatatgacctccggatcactcatatcggtcttggtcttgatatatctgatcccctcgatttcctttttcgcctgttctgcttcatctttattttcaaaagaaaatccaccaacgctcactctctgcgtattttccggcatctgttcttcctccgttccatttacacttcctaagcatatgttattttttattataaaaaataagattacagtttgcaagttttatccgtgcagatatagaatactctcctccgggatagcgagatactgcggcattttttcctgatattctttctgccagctttctttcgggattttccaccagacatcatgttcgaaaacaaccaccagttcaaaaggatcgtcgaggatctttccgttttggcactccaccagattttcacgctgtccgttctccggcagtcttaaataatgtgcgcggatgccgatatgtgtcgtattttccgggatcatgccctttacgcagaccgttgtattccagtttgacagaaccattgtatggtcgtccactctctcgattttttcaatatttttgcagcctgtcagcttcgctgccgccggtgtgccgggatttttaaaaatctcttttgtgataccaaatcccgcctgtctgccatcctccacgatcagcatatgctcacagaaacggtagatctcatcgcggctgtgcgtcaccatcagaatgtctttgtcataaccggacaaaagttccagcagttccaactgcagtttttctttcaaaaatgcgtccagcgcagagaaaggctcatccagcatcaaaacctccgggtctgacgcaaggattcttgccagcgccacacgctgctgctgcccgccggataattttcccggataagaggattttaactctgtcacatgcagcagttccatataatctgccgtctgcctttttatctcctccgcagtcattttctgaccgggacgatatttgaaaccagcctcaatattctcctccaccgtcatgttcggaaacagtgcataattctggaataaataaccgacatgtctgtcctgcacgcgcagattgatctttttgccggaatcaaacaataccctgccattcaaaacaatttttccacgatccggtgtctcaatgccggcaatgcattttaacgtcatgctcttgccacagccggacgcaccgaggattccggtgattccctgttttccttcggtatcaaaagaaacagacagcactttgtcatttagttttttttcgatctccacctgtaaactcatcttttttctctccacgcagattcattcctgccacgatgagcagggaaaaagcaacaatgatcaacacgtattttcctgcggtatccatatccccggccgccacctcagaataaatggcgagtggcagtgtccttgtttttcctgcaatatttccggcgatcatcgcagtcgctccgaattcgccgagccctcttgtgaatgcgagcacgccgccggagaggattcccggtcttgcctgtggcagaataattttccagaaaatggtgcgttcactcatgccaagcgtcctgcccgcatagatcagatttgcatcgacctgctcgatcgcgcctctcgccgagcggtacatcagtggaaacgagatcacgacagccgccagaacggttgcctgccagctgaacacgattttataatgaaatactttttctaaaaagataccggccggtctttttgctccaaacagataaagcaagaaaaagcccgctacggtcggaggcagtacgagcggcagtgtcagcaatccatccagccatgcttttgcttttggggaacggacagacacaacgccccgtgctgcccaaagccccagaaaaaatgtgatgatgatcgatacgaccgatgtttttaacgagatccataccggagaaagatccattttttatgcctcctgaactactatcctgtcttattgctgtgaattgacagtgaatcctgctaccttgaatacgtcaagcgcttcatcggactgtaaaaactccatgaatgcatctgctgcgtctttgttctttgtctcttttaactctgccaccggataaatgactttggaaacacttccctccggtgcttctgccacaaccgaaaccttgtcagtcatggaagctgcgtctgttgcgtaaacgatcccggcgtctgcgcttccctcagccacccagtttaatacctctgtcacgttagttccaagacttaatttaccttccacactgctccagagatccagattctccaatgcctctttgccgtactgtcctgccggaacactctccggatcaccgattgcgatcatatctgcattcacaatgtcctcaaaagaagtgtagccgttctcttttcctgccggaacgatcagaacgattttattttccagaaggtccaccgatgcatcctctgcgatatagccctcctcctgcaatgcctccatctgttttaacgctgcggaaaagaagatgtccacatctgcgccagcctcgatctgtgactgtaattttccggaactgtcataagtcccttcaatggatacttccgggtactgttcctcaaacattggaatcagatgctctgtaaaagatttttccagacttgcggctgccgccagtgtgatcgttccctgaatgtctgcattctgtgctgcaccagatgtttctgttgtcaccgtttcctctgtgctttcattctgtgccggagcatctgtgtttgtatctgctcctttattgctgccacaggctgcaagtcctgcggtcatagctgtcagtaatagaactactgtcaactttttcatcatttttccacatctttcttctgattgtttttatataaaactgcaaattgtctgcaaatttatgattcttttattttcccgcacaatttccggtatttccctttaaaatatcaattccatgcgtcagtgcaccgatcgcatattccagacactctcttaccgccttcgggcttcccggaaggttgacgatcaacgcctctttcctgattcccgacacgcccctggagagcattgccctcggcgtgatctgcagggaataacagcgcatggcttccgagattcccggtgtttcgcgctcaactgcacgcatggttgcctccggcgtattgtctcttttggaaaaacctgttccacctgtcgttaagatcagatccgctttatcttcatccgaaagttcacacaacagtgcggtcagcgagtctccatcatccgggatgatctttttgaaaactacctcatagccctcttttctcacaatttcttcagccaccgctccgctcgcatcctcccgctcccccttagaagcggtatcgcttaacgtgatgactgccgcccggtactgcacatgaaattcatccccgacactgatttttccgccgtgaagcactttcgcaaacacgccgtttgtcggcatgatgcactctcccattttctgaaaaatctcacagccgtgatgacattcttttccgatctgcgttaattccagcaccacatctttgcacgtaaaccttgtcccgaccgggaactttgtaaaatcatagccgctcacgacgagattttctccgaaagccccatctgtaacctctgcaccacgcgccttaaatgcggcgatcgtttcctctgataataaggaaatctgcctgtgccagtttcctgcatgggcatctccctcaatgccccagttttccacaaatactgcggattctatatttttcttctgtgtgccgcgcttttcactgatgcacacagcccttacttttcccatttaaaaacccagcctttcccacaacctgcaaagattgtgtctctgtactagcctccaatttccgacattcctctgtgttctgtccactccggctcattgatttccccaaaatgatggcacttcggtttttgtgtgataatcgtttcaatctgcgcttttaactccgcatccgaaacgccgtcccttaacagtgtccgcagatccattcctgtctcatattgcagacacggctttaaaaagccgtctgccgtcatacggacacggttgcatccactgcagaatttatgtgaaatcgcactgataaatccaatttttccttcaaatccatcaatttccctataatgtgccggtccgcttccaagtttttccccgcacggtctgatcgtcccataagtttcactgagtatgtgcttcacctctgcctcttttaatgtatgtttttcttttccctgaccgatcggcatcagttcgataaaacggacatttacgccgtcttttgcaagttctgccagcgcaagcagctcctctctggtctggtgcatcagcacacaattcacttttacagagatccccgcctgtttttgcgcttttcgcatgccccacaacacagcttccagattgctgtcagaaggtttctttcccgtattacagtctcctgtgaggcgattataatgctctgggtttaatgtatccagactgatattcacaccatcgagtcccgcttttacaagaccatccagctgttgttccaaaaggattccgttcgtcgtcagtgtcactttttccatgccgcattcttctttcagccggaaaataagttcatcgacatgttccctcaccagaggctcacccccggtcagctttacatttttgatcccgagactccggtaaattcccgccagttttacgatctcgtcataagtcagaagttcttcctgtctcagatacgtcttactcgtctgcggcatacaataggtacagcacagattacagcggtctgtgaccgaaatgcggatatagtcgatattgcggctgtattgatctaacattgttctctttccttacttcgctcaaaaagtccggattttccaccgtcttttttttctaaatgaacgtcaaaaatttccattgcgcggtccattgccttgcacatgtcataaatcgtcagaagcgccacattcacgcccatcagtgcctccatctccactccggtcttcccggaaactttgaccgtgcacagtgcctttataatgttttccgtttcctttacctcaaaatcaacggtacatttattcaggcagagcggatgacacatcgggatcagatttgacgtctgttttgttcccataatgcctgccacacgcgctacggtcagcacgtcacctttttttgccgtgtggttgacgatcgcagacatcactgcgtcattcacacggatcttgccgctcgccaccgcaatgcgctctgtgatctctttttcggagacatccaccatcacggcattgccattctcatcaaaatgattccattccatacctctttaaacctttccaaaagaacagtccgggaatctgcactctgcacatccgaggcataagcccccatgtcccagcacataaaaatcttccgctttcaccgggatcccggctgcgatcctcggcagcataatgtcgaaaatagtgctctttgcgtacatcacgcagcccggcagtcccatgaccggcgttccgtcctcaaaatatccgagcagaaacatagctcccggcagcaccggcgcaccgtaggtgacaatctgcgctcccgaacgtttaattgctcccggcgtgcggtcgtccggatcaacgctcatgcctccggtacataagatcatatccacaccttttgctttgtactctgctattttttccgtgataagcgcctcgtcatcccccggataacaatgctctaccgtctcaatgccataggctttcagcttctcaatgaccacatcggaaaaggtgtcccggatcagtccttttgccacttcaccgcccgtcgtgatgagcgccgccgactttaatttataaggaagcacattgacaagcggctctttgcccgcacaccgttttgctgcttccattttttctttttcaatgatcagtgggatgattctggttgccgcaagcttcgccccctttttcaccggagtgtaggaatgcctcgttgcgatcatcatctgttcaagtgaattgactgccagaagtttttccacattgattgttaaaattccgtcaatgtccgaggtcagctcgattttcccctctttcggctgggaggcatgcatatgttctccctgacagatctcacgcaggatctctgccgcctcatcctcatgaagcatgttttcgtttttctcccacacatagagattttcttttcccatggataataacaccgggatatcctcttctgtcacgatatgccccttgcggaatctcgcatctttcgtgacaccctttatgatctgcgtcatgtcatgacataaaacatgaccgacggcttcctctgttttgattaatttcattgtttttcctcttattttgtcttggcgttcgggtaaatgcgcgtcatctttgcgtcatcataatgctcatccatgtacacctgccagttctgcgtcgcttccacctgtctgcctctctcatcatagcgtattagcgccatgcaggacaccacaacattgcagcacataaatacgatcagcatccatgtcactgtcttaccgatcacgacaggaattttttctatccatcctgaaattttcggatacagaatcttaaaccacacaacggctgcgattccccagaaaaagcagtacaacaggttaatccttccgccgaggttaaacggcatccagctgtaatcccagaatacttttccaaataccagctccgtgaacacactgcacagatactcgtaagcaccgcctaaaaaagtgcctgtccagaacagaaatccatcacttctgtccttatatttatataacattgccgtcaccattgcaatcgcaagtccccacacgatactgaatggtccccacaccacactgctgcggctcatccatacccctgctgtgatgcggcagaaaatcgtctccgtgatatctcccaggaatgctcccacaaaaaataacatcacgattttataaaaatcacagccctttgcaaaaacggttttatcctttgtgaccttttccacaaagcttgccttcgggtaggcttttgtcattcgtttttcaatcgatcctgcaatcttattgccaagcctgatgcggaaacgatcgattttgttatttgcttccagccacttctccgggtgtctgctctttcctgtcacaagcagataggaggcgagtacatccaccacaagcacaccgatcagcaccagcagaacaatatgtaccaaaagctgtggcagtattgcaagcaatcggaatacccaccggttggcatacttcaccacaacataacccaatgcaccttttatcagtgaaaccgggagacagatgtaaccgtctaagttccatttactcttactataatcccaccagcgtttatgataaaacctctcaattaactttccagcgacgaactctgtaactgctgcatacagggatgcaaataaaaagagccatagcccggtcagttcctgcaagcccacagacattgcaacagctcccacaccgtacaggatacataacgggccatttaccagcccacggttggaaaatttccggtgcataaatgttgccgcggctgtctctaacacccagcccgcaaaagaatatataaaaaatagccacaataaatcatatccggtaaactgtatcattcgtatgtcctcttcctgttttttcttctatataaacatagatatttttctcgaatacactcttagattatatagaagccgccacttttcttcaagtaaatttaaaaagcctttgcagaaaattctttccacaaaggcttttcaatcacttaaatcaagaaaaaaatagagcgggtgatgggaatcgaacccacgtatccagcttggaaggctggtgttctaccattgaactacacccgcatatcagtcggggtgacaggattcgaacctgcgacctcctggtcccaaaccaggcgctctagccaagctgagccacaccccgagtcaattgtattccactatacattcaaaacttcatacaaagtccaagaatcaaacgtttttgaaagccggtcatctcgattccgcttcgcttcatctcgatgattttgctacgcaaaactccgtctgtaccaagtgccatatccgcagacaagtctgcttcatgccacttcctacatcctgccgtctttctccgctttggtcaagccctcgatcgattagtaacagtcagctccatgtgttgccacacttccacctctgccctatctaccttgtagtcttcaagggatcttacccacttttgtgagggatatctcatcttgaggggggcttcacgcttagatgccttcagcgtttatcccttccggacttggctactctgccatgccgttggccgacagcagatacaccagtggtccgtccatcccggtcctctcgtactaaggacagctcctctcaaatatcctccgcccgcgccggatagggaccgaactgtctcacgacgttctgaacccagctcgcgtaccgctttaatgggcgaacagcccaacccttgggacctgctacagccccaggatgcgatgagccgacatcgaggtgccaaaccactccgtcgatgtgaactcttgggagtgataagcctgttatccccagggtagcttttatccgttgagcgatggcaatcccactttatgccaccggatcactaagtcctagtttcctacctgctccacccgtcggtgtcgcagtcaagctcccttctgcctttgcactcttcaaatggtttccgaccattctgagggaacctttgagcgcctccgataccctttcggaggcgaccgccccagtcaaactccccgcctggcattgtcccatcaccggatcacggtgactggttagaaatccaatactgcaggggtggtatcccaacagcgactccactcaaactggcgttcaagtttctcagtctcccacctatcctgtacgtgcagtaccgaatcccagtaccaaactggagtaaagctccatggggtctttccgtcctggcgcgggtaaccagcatcttcactggtacttcaatttcaccggatgtattgtcgagacagtgctcaaatcattacgcctttcgtgcgggtcggaacttacccgacaaggaatttcgctaccttaggaccgttatagttacggccgccgtttactggggcttaaattcaaagcttcgcttgcgctaacctctcctcttaaccttccagcaccgggcaggcgtcagcccatatacttcacctttcggtttcgcatagacctgtgtttttgctaaacagttgcttgagcctattctctgcggcccactttcatgggcaccccttctcccgaagttacggggtcattttgccgagttccttaacaatacttcttccgccggccttaggattctctcctcatccacctgtgtcggtttacggtacgggcacatataaaacaatagcggcttttctcggcacagggctcacatgcttcgctactttcatttcgctccgcgtcacgctttcggctcatgcagcggatttgccggctgcacacctccttcgcttgcaccggtatttccattcccggcccatgctctccccatgcgtccccacagttctgtttatatgcggtacaggaatctaaacctgttgtccatcggctacgtcttttgacctcgccttaggccccgacttacccagagcagatcagctttactctggaaaccttggatattcggccgagaggattcccacctctctctcgctactcattccggcattctctcttcttatccctccactgctccttccggtacagcttcgtcggtattaagaatgctcctctaccaattgcattcgcaattccgcagcttcggtgttgtgtttcagccccggacattttcggcgcaggacctctcgactagtgagctgttacgcactctttgaatgtgtggctgcttctgagccaacatcctagttgtcttggagatcccacatccttttccacttaacacacactttgggaccttggctggcggtctgggctctttcccttttgactgcccaacttatctcgtgcagtctgactcccgttcatcatctacatggcattcggagtttgatattctttggtaagctttgacgcccccgcggaaattcagtgctctacctccataagactaaaacgaggctagccctaaagctatttcgaggagaaccagctatctccgggttcgattggaatttctcccctacccacacctcatcgccacccttttcaacggatgtgcgttcggtcctccattgccttttacggcaacttcaacctggacatgggtagatcacccggtttcgggtctgcggatactgactatatgcgccctcttcagacttggtttcccttcggctccacaccttaagtgcttaaccttgccggcatccgcaactcgccggaccgttctacaaaaagtacgcggttcatcatgtaaagatgtcccacagcttgtaaacacagggtttcaggttctctttcactcccctcccggggtccttttcacctttccttcacagtactatgcgctatcggtcactaaggagtatttaggcttacggggtggtccccgctcattccatcaaggtttctcgtgtctcgatgtactctggataccgctcagctggctttcctttcgcttacggggctttcaccctctccggcaggctttcccaaaacctttctgctaggatcatcagatcttaaatgcggtccgaaccccggagtgcacgcactccggtttggcctctttccatttcgctcgccgctactttggaaatcgataaattttctttctcttcctcgccctacttagatgtttcagttcaggcggttcccctccatacgttatggattggcgtatggatgcatgaggtgtgctcatgcgggtttccccattcagacatctgcggatcagtggatatttgctcctccccgcagcttttcgcagcttatcacgtctttcatcggctcttagtgccaaggcatccaccctgcgctcttttttgcttgacctctcttttaccatttcaatagcgtttgaaatggggtctgctttttaaaaagcttgtaattagtttttcaactatgtttacgtttggttatttgttttctcggatgtcttgatcaaatatatgttttcacagatatttttctcaatacttatctctgtatgaagttttcaatgtacatagcatttcgcgcattggcgctcatgcattagaagttacttcgtaacttccccgtcatgctactcttactctgtttataaaaagtatcatgacttttgactgaatctttatcagtcattagaaaactcaatcacttgaactctctaatcactggtaaaaccagttatttttttgttgatctggcagccacctgctttcccataccgtcaccagtatagtatcatcggccgctttcgtcttaaccatcgtgttcgggatgtggacgggtgtttcccaaaagcgcatagccaccagaaaatcgcatctcgcacattggtgctccatgctttagaagttgcttcgcaacttccgctgtatcgaagtttatcgaccagctgttatcaagttttttcttgataactgaacagtgaataacttttactcgatttccttagaaaggaggtgatccagccgcaccttccgatacggctaccttgttacgacttcaccccagttatcgaacctgccttcggcagctccctccttgcggttgggtcactgacttcgggcatttccaactcccatggtgtgacgggcggtgtgtacaagacccgggaacgtattcaccgcagcattctgatctgcgattactagcgattccagcttcgtgtagtcgggttgcagactacagtccgaactgagacgttatttttgggatttgctccacctcacggtctcgcttccctttgtttacgccattgtagcacgtgtgtagcccaagtcataaggggcatgatgatttgacgtcatccccaccttcctccaggttatccctggcagtctcctcagagtgcccggccgaaccgctggctactggggataagggttgcgctcgttgcgggacttaacccaacatctcacgacacgagctgacgacaaccatgcaccacctgtctcttctgtcccgaaggaaaggacacattactgtccggtcagaaggatgtcaagacttggtaaggttcttcgcgttgcttcgaattaaaccacatgctccaccgcttgtgcgggtccccgtcaattcctttgagtttcattcttgcgaacgtactccccaggtggaatacttaatgcgtttacggcggcaccgaaaagctgtgctttccgacacctagtattcatcgtttacggcgtggactaccagggtatctaatcctgtttgctccccacgctttcgagcctcagcgtcagttatcgtccagtaagccgccttcgccactggtgttcctcctaatatctacgcatttcaccgctacactaggaattccacttacccctccgacactctagatgaccagtttccaatgcagtaccggggttgagccccgggctttcacatcagacttagccttccgcctgcgctccctttacacccagtaaatccggataacgcttgcaccatacgtattaccgcggctgctggcacgtatttagccggtgcttcttagtcaggtaccgtcatttcttcttccctgctgatagagctttacataccgaaatacttcttcgctcacgcggcgtcgctgcatcagggtttcccccattgtgcaatattccccactgctgcctcccgtaggagtttgggccgtgtctcagtcccaatgtggccggtcaccctctcaggtcggctactgatcgtcgccttggtaggccgttgccctgccaactagctaatcagacgcgggtccatctcacaccaccggagtttttcacactgtaccatgcggtactgtgcgcttatgcggtattagcagccgtttccaactgttatccccctgtgtgaggcaggttacccacgcgttactcacccgtccgccactcagtcactaaaacttctttccgaagaaatcaatcaaagtgcttcgttcgacttgcatgtgttaagcacgccgccagcgttcatcctgagccaggatcaaactctcatgttaaaaagttaaatccaaaccagaatatctggctttctaaatcagaaacaagtccctaccggaatcttgattcaggttttactgtttttaaggtttgctttattaaaagctgttcgttcatctttcgatgacttgaattattctcgcgaaccaaatctttttcgtaacccggaagaaatcgaagatttcttctgagcggacttgttcgctttaggatctttcaaggttattcactgttcagttatcaatgttctttgttgtttccgctttgttcaagcgacttatttgttataccacagttatttttatctgtcaacaacttttttaattttattttttcagacttttttataaattgtttttatttcaaaaacatttatgttccgtggacaagacagaatgttaccatagcattttcttttcgtcaagtactttttttatatttttattttcttttataaaaagagccaaagaaaaagttccatccgaagatagaactttttgaaacacccgaatatatgctattttctgcgatcgattccggtccttttataatacgctgctttatctgcatacattctcttttcagattcctgcagtaatgtatctaatcctgtctggtatttttcacgccatatttctcccactgccatatttacattattttgtttcatgtattcttttaaaagcccaatgcgttccatcaatgccgcatgttcaattcctgcacacagcgcaagcagttcatctccaccgatacggaacaaaccatactctccaaatgcttttttcagactgtcgcaggcacgaagaatcaactgatccccagcctcatgccccattgaatcgttcacacgtttcaatcctgtgatatcacaataaacaacgcctatgctcttttctgcgtcaatctcattgatatatttttccattgcgaaacggtttccgagttttgtaagctgatctttatagctcatattctccaactggctcatcagattccttcttttgatacatgacaccagaaaatgtcccataatctgaagcatattagatgcatactccaatgatggaggcggcggattatccacaccgtaaaaagcaattactttcccatcatcatacaaaggaacaaccacaagtgaatgaatgttctgacgcttcaaattctcatattgtaaaggatcgctttccctgatttcctcaagatccttaaagacaataaactttccctcctgaaacatccgataccaatgcgcacagatttccggaggaatatcctgcaaattttctttttccctcgaaatgccttccgcaacccactcgtaggtattatcatccctgccccgctcgttgcgctcaaaaatataggttctttccccattcaacgagttgcccagatattccagaataacctcgatcgattgctccggcgttgccgtctgaagtgcaatgcgcagaccttcgttgatcataaattccatgttctgatatttttggattacgccgtcctgtgtgcgttcttcgctgatatccacaccaatttcaacacgatattttttcccattggcagagtcctcgatcagcgtatcctttaacatcagataacggtcaatgatcggattatagtaatgccattcttcaaattcgcccacactcagcctgtcattgttacacataccacaaggaatcaatgttttctgtaataattcatagcatttttttccttttgcatcttcaagtgattgtaaaccatatacctgcagtgttttccggttcatgtatacaatctcatgcgtttctatatctgtggcatacacatattcattcatattttcaaaaaactgccatatatcttttacttctttcatcgctttctctttcctgtatttgatatgcttgtatgatgatattattataacataccccagaaaaaaatagtgtaaaaactttttgttgcttcaatttccacttggttgctctgatctgccgctccatctggtgctgtttctgcgtggattcataattttaaattgcatgcgctcagacattattttgctaatttcaacaaatatccgaaccataaaaaatgcctgaaaccccagaaaaatcaactattttctaagatttcaggcacttttttgatagtggacctgacgggaatcgaacccgtgtccaaaaaccaatcccctgtccttctacgagtttagtttatccttagacattccctccggcatccaggaacaaacaaccgaatgctttcagtagcttcatgatacgcccaacagctcaaagctttgctgatgtcgtttcctacatagtcgaagcctgggtcccaaagtgtaggtgctctgggtcagactgctgccaaattaggcagcgtatgctaaattatcttcagcgtttaattttaattgtggaatttgacgcatcccgtgcgactcgcttctccagcttcatgatccctgtcgaaaccattacaagcccatattttctaattgccggatgcatccataccggatactccgtgaaaccgcggacggtttctctctaaccaaggttgcggatcttaaaatcacgctccgcctcgcggcgcatatccttcttggcgatatcctgtctcttgtcgtagagttttttaccttttgcaagagcgatctgtactttcacaaggcttcccttgaaataaacttccaccgggacaagcgtatagccctgctctgcgatcttgccgacaagtttgcggatctctgacttatgcatcagaagtttcttcggtctcagtggatctttgttgaagatattgcccttttcatagggactgatatgcattccgtatatgatcacttcgcccttttcaatgcggacaaatgcttctttgatactgcattttcccatgcgcagagactttacctctgtgccgtgaagttccacacctgcctcgtatttttcctccagaaaataatcatggtgagccttcttgttattcgctattaacttgatttcctgctttgccatgatccttacctcctgctgctgttacagtataacccagaagtttatctttcgcaataaacttctggttaaaaaatacaaattttataaaaatttaatctgtcatcttcgacaaaacagatgcctcgtccttgaccgcttcatccggttccacatcatcccgcacaacgcggaaatcgatagtgcgcatgattttgtctgtatccgccacgatcactttgaccttctgaccgagcttatagtgtttgttcgtgcgctccccgatcatctcataggacgactcctcgtaatggtaaaaatcatcggtcagagacgtcacatgcaccagtccttccaccgtgttcggaagttctacatagaatccccactcctgcacgccggagataacgccctcaaacacctgaccaatacgttcttccatgtattccacttttttgagtttatctgtctcgcgctccgcctcatctgctctccgctccatctcgctggaatgttttgcaacctccggcagaatactgtcataatgttcgatccgtttctggttcatcctgccgcgcaggttgtccttgatgatcctgtggatctgcaggtcagggtaacggcggatcggtgaagtgaaatggcagtaataatttgtggcaagtccgaaatgcccggtgctgactgtcgtgtattttgcctgtttcatggaacgaagtgtcaggcggctgatcagagcctcctccggtgtaccgtcaattttcatcaataatttctgcaattccttcggatggatctcatcctgtccgatatggatggtatagccgaaattattgataaaggttcctaattttttgattttttcggtgtccggattatcgtgcgtccggtatacaaatggcagttcctgccagaaatagtcctgcgccaccgtctcgtttgcgatgagcataaaatcctcgatgatcttcgttgcaacattccggtcatacggtttgatatcgaccggttttccctgctcgtccagaatgatttttgtttccgggaaatcaaaatcaatcgagccacgcttcattcgtttctttcgtaaaattgcagcaagctctttcatctgctcaaacatcggcacaagttctttatactcttcgatttctgcctcgtcatgttcttctaagatttttttcacactggtatagctcatgcgcctgtccacttttatgacggtctctgcaatggtgtggtcggtcacatttcctttttcatcgatcttcatgatacagcttaacgccagacggttctctcctgcattcagcgaacagattccatttgacagtttgtgcggaagcatcggtatcacgcggtcgacaaggtatacggatgtccctcttttgagcgcctccacgtcgagtgcgctgctctcctgcacatagttggatacatcggcaatgtggaccccaagttcataaagatccccctcttttgtgagcgtgatcgcatcatcaaggtcttttgcgtcctccccatcgatcgtgaccgtctgccagtctcgcagatccatgcgcccagccatgtctgcggcactgacttcattcgatacattttccacctgtttcatgatcttttgggaaaactccaccgggagatcatatcccttcacaatggacatgatatctgtccccggatcgttgatatgtccgatgatctcaacgacttttccctccggctttttgccgttttttccataatctgtgatctccaccacaactttgtgcccggaaaccgctccctttgaccgctccagcggaataaaaatatcctgcgcaaatctcggattgtccggcactgcaaatccaaagtttttacttttttcataagtgcagacaagctgctctgttcctctggataaaatctttgtcaccgttccctctttgcgctttccactgctgttttttgacagcgtgatctggacggtatccttatgaagcgctccgttcgtctgtgcagccgggatgaaaatatcttcttcctctccctccacagtcacaaaaccaaaccctctcggatgtgcagtaaaaacgcctgtcagatattttccctctgattttacatattttcccctgccggatatctctacttttccatctgcagtgagtgcgtctaacacttccaataattccccgcgctgtgatttcggcacatttaatacaattgccatctcttttgccttcatcggcacatagagttcatcacagatgaaatcatagatcattttctttcgttcctgtaataattctttgttcataacttctccattttcccatagtatacgatcatttttaatattctgataatagaatgacaaaaaaaagaccatcgtattcacgacagtcttttgcgtttcttaaaaaattcccagattcaatacagcagcaatcacaataaataagacaaccagaatcttggttcctgttaccagtcttccctccatggaacgtcctttgttcttgccccagtaagtatcagctgctccggcgatcgctccaagtcctgctgacttaccttcctgcattaaaatgataactgtcaatgcaatactgattataataaaaacaactgttaagattatttttaaaactgccactttattttcctcctacggttataaactcacaacttcaagcagtataacacatacccgccatattttcaactgttttttgtttcctctgatgtgattgcgccatccacgcataccataaccatattcggcaatgatttttcaattgtcataaatgaatctgctccttactctccccacatggaatccatattgtgaaaatgcgcacagtcatctgcctccctgatctccgagattggcgctgtgctatattttaaataattctttctggatgctttctcaaaatatccattaattctttccacaacaatggcacaatcctcctgcctgattcctaaaagcagcatcaggaactgattatcactgtatctggtaaacatatccccgcgccggagagaattacggattgcctgttccagttcctctgcaactttgccaagacgttctcctttctccaacggaactccttttccatccgtcatggtacacaaaagaagataggcagactgccctgaacgctcaatcactctctgcacataccggtatccttccataaaagaaagataactgcagaaaaaagctccatcgtctttttctctctggtttaatccctcctggatctcattcacatgatccgctttatcatgcttcccgattttcgtatttttatcattttctttttatccttcatacactataatatacataaatgataaacgacagccgttttattccaaaagaagcgctgccgcgaaaaaatatttaaggagaaacaatatgacccccagaacaaagggacgtttcatattacttccaatgctcctgtgtgtctgccttaccctttgttcctgtggcagtaacgaaagtgccgaaaaaccttctgcagcatcctccgatactgtggcgaaggattcctcttcgtccaccacagctgctgccggatcccgggacaatactcctgttgtactgacaggcagtgcagacggcaccgttacctatgggaatgattccgttacagtggatgcctcccatacggaagaaggctatcttatggtttcctactccggttccaactccaaagtcaaattgcagatcacaggttctgatgagatcacttacacatataatttacatgatggttatgaaacctttcccctcacttccggaagcggttcctacaccgtcggcgtatttgaaaatattgagggaaccagttattccaccctttttacgcaggcaattgatgtgacgatccaggatgaatttggtccatatctgtacgcaaaccagtatgtaaacttttcagcagactccaaagtcatctccaaagccatggaactttctgcatctgccaatgatgatctggaagtaattgaaaatgtctataattatattatcacgaattttacttatgattatgataaagctgcatctgtgcagagcggctatctgcctgatgtggatgatgtccttgccagtcagaccgggatctgttttgattacgccgctgtcatggcttccatgctccggtgtgagcggattcccacccgccttgaagtaggttatatgggtgatgtctaccacgcatggatcagtacttatatcaaagataaaggctgggtaaacggaattattgaattcgatggaaatgattggaaactaatggatccgacttttgcttccacaagttccgatccaaaagattttcttacccagacagatgaatacattacaaagtatgtctattaacaggaggtttttctcttatgaagaaaaagaaacagcagatgctgggcaaccttgagatcgcagcattctgtgaccagctttccatgatcgtttctgccgggattcccatctatgaaggaatctccattctgcaggaggacgcaccggaagaagaaactgccgaaattttatctgttatcagcaattccctcgatcatggaagttctttctgtgatgccttaagggaaacaaatgtatttcccaaatatgttctggatatgatcgggatcggtgaacttgcgggcaaactcgaagaggtattaaatgcactgaccggatattataaaagggaagaaagcatccaaaacagcattaaaaatgccgtcacatatccgctgctcatgattgccatgatgcttgccgtcattctggtgctgattgccaaagtacttcctgtttttcatcagatctatatggaattaggaagtgacctgaccggatttgccggagcgatgatgagattttcagatgcattgaaccagtatctgtttgtcattgtgatcgttctgatcgcagctgccgcaggcatttttcttatttcaaaatctgacgcagggcaaaaattcttcaagaaaagaccccttgcattaagcaccgctgccagccgctttgcaaactgcatggcacttgcattaagcagcggactcgatacggatcagggacttatgctcgcagaacagcttgtagacaatccttacatggcttcccgcatcaagaagtgccgcgacctgactgcttccggcaggggatttgccgaggcggtcttaacgtccggtattttcagtaagatctatacttccatgatcacgatcggtttccgcaccggttccatggacgaagtcatgcaccagatttctgaggaatatgaggaagaaacagacaaacagattgcaaagtttatctctgtattagagccaaccttagtcattatcctgtccattttcataggactcattttaatttccttccttctgcctctcattggcattatgtcaagtatcggctaaaagtaataggaacagcgaggttcttttatgatacgattgaaacaaaaaaagaaaaaaaaatataaacagctattgtgttctgtcgttcttcttgctttgacactttttgtatttggttttgcagctgaccgcatccgcctttccaatgaatccgagcagacaaccattttagaaaaagcagtcacccggacgatcacacaatgctatgctttagagggcagttatccacctgacattgcttatctcaccacacattatggtctgacctatgatcctgaccagtatctgatcgactatcagtacatcggctcaaatttaagaccggatgtcactattattaaaaggaactgattttatgcttgaattaaagaaaacaccggagcatacgatcgaccgtgtcttcctgcttgcactgctggcgctttttgccgccactacatttttagttgtctccatcggagcaaaacagtatcattcgattgcagacagcatgaccgcaaattatgagacccgtaccgtatcctcttatctggaagaaaaaatgaatcaaaatgatgtggcgggttctgtcgcagtcacatccatcggtgcctttcctgccatcgccttatctgagactgtgaatgacgcgatctacacaacctatatctactgttacgacggatatctccgcgagatcacagtttccgatggaacaactgttttaccgggagatgggcagaaaatcattgaaaccaaggcacttgccattgatatggtcagctcaaatctttactgctttaccattacggatacgaccggatacacctatccgctttatatctcactgaatgcaaaacaatcgtaatttgcaaaaggagttttcatgaatcaataccgccactcaaaatccagtctctttttgatggagattattttaaatattctgtttttttcgattcttgcaacattttgtgtacagatatttttcaaaggataccagctctcgaaaagcacagaaaaactgcatcaggcagtgaccgcatgcacgtcgatcgcagaaatctgccagagtacggattccctggaggaaaccctaagttccatctatccggaatccatgagtctgaatgaaacaattttaatctactacaataaagattttcttgcctgtggaaaacaaaacgctgtttatcgggcaacggtagattttttaccggatcagcttgccaccatccacatcacctttttggataccagcactgctgaaacactttatgaactgtcagcttcctgctatcagccaatttccctaagcacaacaggaggtatgcagtatgaataagcaaaaaaaaggatttatccatatcggtttttcatccatcctgatggtttttaccatgttatgtctggtgacttttgcgacgctctctctgatcactgcaaattcagattacagattaagtcttaaagttgcagaaaaaacaaccgcctattacgaagcagatactgctgcaaggaactatctgcagcaattagatctggcactcgcagacctttacgcaaactgtgatgacagtcagactttttttgaaaaggctgctgatctgataccggaactgaaaacagaagatacgctgaccgcgggatcgcctacgattgtaggtaattgtccaacctgcacatttcaggttacgatcaacgatgtgcagaatctttatgttacattagaactcctttatccggaacatcccggagatgaattttataaagtcacacagtggcagaccgtcacgaacaatgaacctgtgattgacgatgactcacttcatctgtatcagggaaattaattataagaaaggtttggttatgaatatgaacgtcagagaaattttagaaaatatcacaaaagagcatgcatccgatatctttgttgtcgcaggccgtccgctgacctacaaagtaagcggaaagatgcatacttatcaggaagaacgcatgaaaccggatatgtgccgcgactttgtcacagcgatttatgaacttgctgaccaccgcgatatttcccaatttgagacaaccggtgacgacgacttttcttttgccattgtgggagtgtcaagattccgtgtcagcacttataaacagcgtggctcttactccgccgtcatccgaatcatcacattcactttgccacagccaagtgaactgatgatcccggatgctgtgatggaacttgccaacaccaacaagggaatggtgctcgtcaccggtcctgctggtggtggaaaatcaacgacattagcctgcctgatcgacaagatcaacaccgagcaggaagcccatatcatcacattggaagatccattagaatacttgcacacccataaaaaaagtatcgtaagccagcgtgagatatgcaccgacactgaaaattatctcacagctctgcgcgcttcccttcgtcagagcccggacgtgatcctgctcggtgagatgcgtgattatgagacgatcaatacagccatgactgctgccgaaaccggacatttgattttttcaacgcttcacaccatcggggctgccaataccatagatcgaatcatcgatgcatttccagctgctcagcagcatcaggtggcggtacagctctccatggtactacacgcagtcatatcccagcgtctgctcccgaccacggatggaaaaatggttccggcttttgagatcatggtgttaacgcccgccatccgtaacatcatccgtgaaggtaaaacacatcaaattgacggcatgatctacacctccacgaacgagaatatgttagcgatggataccagtattttccgcctatatcaaaagggcatcgtcgataaaaaaactgcactcgcaaatgcttccaacccggaaatgatgagcaagaaaataggagccatttaggctcctatttctttcggattatctcggctttcccatatcttgcagattcttttaactcttcctcaatacggagtaactgattgtatttggcggttcgttctcctctgcacggtgcaccagtcttgatctgtccggcattcactgccaccgcaagatctgcgataaaggcatcctcggtctccccggaacgatgggagatcactgcctgataaccagcacattttgccatctcgatcgcctccatcgcttctgtgacggttccgatctgatttactttaatgagaactgcatttgcgacgtttaaatcaattccgcatttaatccgctttggatttgtcacaaaaaggtcatcccctacaagctggactctgccaccaatgcgttttgtcattttctgccagccttcccagtcatcctcaaataaaccatcctcgatcgacacgattggaaattcttcgatcagttcttcatacagagcgatcatttcatccgcactccgcttcacactgtctttacaatagtcctttgcagagccttctccggctccctcttccggctcttttcctgccgctctggattctcccgggaaaatgtataccccagcctcctcgtcatacagttcgcttgccgctgcatccatggcaaacaccacgtcatcacctacgtgatagcctgccttttccactgccttctgtaaatagcggaatacttccctggtgtccttgacatccggcgcaaatccgccctcgtccccgactgcagtgcttaatccctcctcgtttaagatctgacgtaggaaatgatagatttctgctcccatacggagtccgtcatgaaaatcgagtgctcccaccggcataatcataaactcctgaaaatcaatggaattttttgcatgcactccaccgttgatgacattcatcatcggaaccggaagaatgtgtgctgccgttcctccgagataacggtacaacggctgttctaatgcttttgccgcggttttggcacacgccatggaaacaccaagaattgcatttgcaccaagattccccttattatccgtgccatcctcttccaccatgatgcggtcgattcctgcttgatcgagcacattaaagccaatgagtttttccctgatcttctggttgacgtgatccactactttccggacacccaacccaaaataccgttcttctccatcccgaagctcgatcgcctcaaagcgtccggtacttgcgcccgatggaacggactcgcgcgccgtgatcttttttccggttgtctctgtctcggcggtcacttccacttcgaccgtcggatttcccctggaatctaaaatttcccttgcatgaacatcaatgattttaataaataaagacatactttcctccttgcatgaactgctttttggaatagtatgtcttttgctgtttcatattatgtaatttttctgatgcatctgttttggttatgtaagcgtttacattatgtattcttacacatttctcattttcgtcaatatatatttttgattattttgtatatttcgcatatttttgttgatattgcacgtatttattttaacatttttattatttttgtcatttcttttgttgctttattttttgcttgatgtataatattcgtgattgtggtgtaactgctttcatttttataatacaccagaagctttattatagtgtaagaaaatccatttcttacatggagtacatttttcaggggatttactatggcaatgacaatttacgacatttcaaaaaaagccggtgtttccatcgccactgtatcacgtgttttaaatggcagtgaaaacgtccgcccatccacccggaaaaaagtcatggatgtcatcgacaaatacgattacactccaaatgcttttgcccgcggcatgggactgcattccttaaaaacgatcggtattctctgtgcagactcgtctgacctttttctcgcaaaggcagtctactttctggagcaggaattacaggcgaacggatacgaatcacttttatgctgtaccggttataatccggacatcaagaagaattaccttaatttgattctttccaaaaaggtggacagcattatattggtaggttcgcacttcatcggtttcaacgaggatgagaaccagtatattaaggatgtttccacgcaggtcccgatcatgctgttaaacgcttcctttgatcatccgaatgtttacagtacactctgtgatgattatggaaccatgtttgaggctgccaccgaaatgatccagtcaggcatcacggatatcctgtatctatatgattccaaatcctacagcggtttaaagaagcttcacggattctgcgacgcaatgaaagagcacaatattccggggtttgaaaagctgatccacttttatgacggtaatatcgaacatctgaatgaggttgccgattttgtggcccgcattgcaacaaaaggtacgtcctttcatggcatcatgacttcagatgattcccttgcgatcggcagtatcaaatatgcacagaaaaaagggatacgtatcccggaagaattatcggttatgggatataacaattccatgctgacaaactgctgtacgccggaattaacctctgtcgacaaccgtttagaaacccagacacaccagttagtccagacattgctcggtgttttagccggagaggaaatgccaaaaaaatcgattttctctggaaaaatcataaaacgaggaacaacattattttaacttttaggaggacattattatgaaaccatttatggacaagaattttcttctttccaacgaaacagctcagaaattatattttgattatgcagcgacaacacctgtattagattatcactgccatatcaatccacaggaaatttacgaggaccgccagttcgaaaacatcactcaggtatggctcggcggcgaccactacaaatggcgctttatgcgttcctgcggtgtggatgagtattacatcaccggagaagctccagacaaagagaaattcttcaaatgggctgaatgcttaggaaaagcaatcggaaacccacttttccactggagccatctcgaattacagaaatatttcggatacaacggtgttttaaacaaaaaaactgcggaggaagtctggaatctctgtaacgcaaaacttgcagattcatccatgtctgtccgcaatatcatcaaacagtccaatgtaactttaatctgcacaacagacgatcctgttgatagcttagagtggcacaaaaaaattgctgaggacaatagctttgacgttcaggttcttccggcatggcgtcctgataaagcaatgaatatcgaaaaaccaacttatcttgattaccttgcgactttatctgacgtttccggcatcaaggtagattcctttgcttctttatgtgaagcattaaaaaaccgtatggacttctttgcttccatgggatgctctgtatccgatcacggtttagagtatgtgatgtacgctcctgcttctgctgagactgtagaatctatttttgcaaaacgtcttggtggagcttccatcacaaaagaggaagaaatcattttcaaaacagcatttatggtttttgttggaaaagagtacgctaagagaaactgggtaatgcagcttcattatggatgcaaacgtgacaacaacactccaatgttcaacaaacttggtcctgataccggttacgactgcatcaataactatgctccatcttccgaaatggcagatttcttaaatgcattaaacagtacagacgagcttccaaaaaccattttatacagcttaaatccaaacgataaccagtccatcggtacgatccttggatgtttccaggattccactgctgttgcaaagatccagcagggttccgcatggtggttcaacgatcataagaccggcatgactgaccagatgatctcccttgcaaatctcggaaacctttccggttttgttggaatgttaacagattccagaagctttttatcttacacacgccacgattatttcagaagaatcctctgcaatctgatcggcacatgggtagaaaacggagaatatccggctgattatgagacactcgaggaaattgtacgtggaatttcttataacaatgctgtaaactactttaattttaatttagagttagcaaaataatttttatttaaggagaaggatgtattatggaattacgaactgccgcttacaggtggtgacacggatttccggagtttaactagcgtagtgtcgcagattttgtggtgcttttatcggttgtgaagggcagatataagcgtcctttcacaagtcagaattttatatgtaaggaaaaagaaaaacggtataaacgaaatattatgtttctgttcgctgggcattccgataggcttctgaacaacaatcttgagaagcagagcttcccaagattgttagaatcctatctccatagctcacaaagaaaataatatttgtttataccgtttttctttcatttacgttatggatgacttgtgagaggacgcttatacatgcccaatttacgctatgaattgcaccacaaaatctgcaatttacgttatggaactcacggttatgggatgagtgcctataaaggaggtgtcgactaaattcagtcattctcaatgccttgcgattcgccaatgataaagggtacacctcccggagtttaagctttgattactgccgtttgtaacctggattgacggattttcacaacctggatattgcatgccgcacagtcttggacaaataaaaaatagaactgatttgttttcaggattttgggagcggccggtccttagaaagcagacattgcgatttcaaaagacaatgtcaattggattttgaaatcacgatggatgctttcttagtaccgctgccagcgacaacaagcggaagcgctcctgaaaacaaacagttctattttttatatttctatacactttgttggcatgcaattaacacaacctgcgaaaatccgtaacaccgctcacaggcggcagttcatacgttaatctccggtttaaccgcgcaggatggcgatattgcgttttaatgaagcaagcgccgtatcgacatctgcccgtgtcgtatcgccgcagagcgtgagtcttatcgtacctggtgcatattcttccggcactcccaatgccttgatcacataagaaatccgttcttcacctgtattacatgcggaaccgcctgatgcacagattccatcttcgtccagcaaaatcaacagcgatgccccctcaagtcctttaaaactaaaattcacatttcccggtaaccggatactgcgatgtccattcaattttgcatccggaatttcatgcatcacacgctcgatcagataattgcgaagcataatttctttttgtactctttttctcatgtttccgtaagcaatctctgctgctttcgccattcctacaattccggctacattctccgtaccggcacgttttcctctctcctgacttccgccatggataaaagatgggatatcaatgccatcacggatatacaaaaaaccaacgcccttcggtccatgaaatttatgtgcacttgcgctcagcagatcgaccggataataatttacggaaagtggtatctgggcatacgcctgcacagcatctgtatggaataaaatctgtttttcgcgcgcaatttttccaatctgataaattggctcgatcgttccgacttcgttattggcaaacatcacagaaatcaacgttgtatccggtcttatagcatccattacctgttccggcgaaatcagtccatccccgtccacttccagataagtaacatcatatcccagtttttccagatactcgcaggaattcaaaatggcgtgatgctcaatgttggttgttataatatgccgcccttttttcttacaggcggctgcaatattttttactgcccagttatcagactccgaaccacctgatgtaaaataaatctctgaggtttttgcatgcagggttgctgcaatgacttccctcgatttttccaattctcttctcgcatcttcaccgatactgtaggctgtggatgcatttccataattttcctgtaaataaggttccatcgcctgttttacagcatcagacatctgagttgtcgccgcattatccagataaatctgtttactcattttctcctcacttctctcatatactaaattgatgaatctggcacttccaaacgcactcatttggtgtccagaaattcgaatcccgggaggtcaaatgtcaaaaaatctatctgtaaaaagaactttatttaccggaaccctgctgctcacaactgccggcatactctcccgtttcattggtttcttctataagatattcctctcacgcacaattggtgcagaaggtctcggaatttaccagctgatttttcctgttatggctctttgtttttccctgacctctgccggaatccagacatctgtctcaagatttgtatccagtgagattgggaagcaaaatcctgcaggagccagattttatctgctgatcggactgattctgtctgtatgcctgtctgtttttaccggcctttttatgtggaatcattctgaatttatcgcaggctcgtttctgcaggaaacgcgctgcgccccgctgatcaaaatactgtcattctgttatgttccgtgcagtatccactcctgcattaacggttattattacggattaaaaaaagcgcttgtgccgtctctctcccagcttgcagagcagtcagcgcgtgtcgggggtgtctatctgatttatctcgttgcacagagtaacggccgatccattgccatctctgacgccgtgtgggggcttgtacttggtgaatttgcaggaatgcttgtctccttaagctttatcggttttggagcctgtaaaggcaatataagaaaaacgacatggtctttgcttaccatgtcgtttcctctgacgctcaaccgcctgacgcttaatttatttacaactatcgaaaatctgcttataccataccagctaaaattgtttggatacagttcctctgacgcactgagtatctatggcatcctgaccggaatggcatttgccatcatcatgtttccaaccgtcctgaccaattccatctccgtccttctgcttccggtcgtctccgaagcccaggcgaaacacaatgacagactcatccgggaatctattataaaaacaactgagtcctgtctcttgctcggtctgctctgcacgatcggacttttggttctcggtgattttatcggcaactttattttcaaaaatgcgctcagtgccacttttatcgttacaatgagctggatctgcccgtttctttatctcggaagcacgttaaacagtattttccacggacttggaaaacctggcatcactctgtttttaaaccttttctcctgcctgatccgtatcctttttattgtatttctgatcccggttatcggtatcagaggttacctgaccggtcttttgatcagtcagatcgcgctttgcgtccttgctttgctctggctctaccgcctgatgaaaaagggcagttccggataatctccagactgccccttttctctgttcctataaaaatttacaagttctacaaaacggtctttccatgctttacaatttgtctgatgttaaaatcttcatccacgatcacacagtcggcatatttgccattgtcgatacttccatatttctcccacagtccaactgcttttgcaggattctctgttgcacatgccacaacctcctcaaatggaagtcctgcttctttgactgtgaacttcatgcagttaaataagttggttacagatcctgcgatcgcaccgtccactgtcagggttgccttattgccatgtacctgaacttcctgtcctcccagagaatagattccatccggcttaccggttgccatcatactgtcactgatcaggataatcctgtcttttccaaacatcttaaaactcgtgcggatggtggatggatgcaaatgtacaccatcgcagatcatctcaaccataacattttcattatcacaggctgctccgatcacgcccggtgccctgtgggtaaatggaggcattgcattgtaaagatgtgtcacctgtctcgcaccatgttcaaatgcttcctttgcagtatcataatcggcggttgtgtgtgccactgacacgcgcacttccccttttacgctgtcaataaattccattgctccaggttcttccggtgccacaacgcagacacggtataatccgtccgcctccttctgcagcctgcggaacatctccgcgtcaggtttatgcacatataatggattctgagcaccttttttctccatggaaataaaaggtccttccatatagattccgactaactcagcctcttttgtaagcagtgtctcatccgctttctgctcctcatggaatgtttttgcagctttgctgatcgtcgtcagttcctcctccgacaatgtcatcgttgccgggtgaatggaagtgataccattttgcagctcatactctgccatgtggcgcatcgcctctacgattccgtcacagaaatcgactcctgcgcaaccatgaaaatgaatatcgatcagtcccgggatcacataacagcccgctgcgtcgatttcctttccatcgccggaatctgctgcgaaaaagctgccatctgtcgctacttccttctcaacgaattttccattttcaaatactttaccgtttaaaatcttcattgcgatttcccccttgtcctgtccggtgcttttttctatacacggaacagcttgtcttttttttcttagcttttattttagaatcctgctcatggaaagtcaagtttcacgcaaaaaaacacagaaatatacaaaaaatgcacaagaaaaaccccggaaatataaacttccggggttgtctgttatgaatcgttatgaaaaactacttgtccgcattaaacacgtgataagtattcacctgtacgtgtatcaatcttgatcacatcatcctgctcaacgaataatggaacatatacagttgcaccagtctcaacaactgctggttttgtagcacctgtagctgtatcgcctttgaatcctggctctgtatctgtaatctttaactctacgaagagaggtggctctacggagaatacgcttccgttgtgagaacataacttaaccatctcgttctcttttacaaattttaatgcatcaccgatatcatctttggataatgcaatctggtcgtaagtctcaacgtccatgaagtaatataaatcaccatcagcatataagtactgataatcttttctctcgatacgtgcctgaggacatttctctgttggacggaatgtcttctcaactacaccaccactcttaatattctttaacttagttcttacaaatgctgcacctttacctggtttaacatgctggaattcgataatctgataaatgttaccttctaattcaatagtgataccatttctgaaatcgcctgctgaaatcattcaaacttcctccttaaaaaattgcgtacgagcacaaggctctctgatttttctattttataataaatagccacacttttcaagctttttttgtggaaacaccatgtttctctgaataaaaagctatctttttcccatattttctagtttcttgtctcaatttcgtggatcatatcaattcttgtctgatgtcttccaccctgaaattctgcatctaaatatgcttttacaatgtcttttgcaagctcgcttccgacaatacgcgcgccaaatgcaataatattggcattattatgctcttttaccagtcttgcagttgcacagtcggaacatactgctgcgcggacaccgtttaccttatttgctgcgatggagattcctactccggtaccgcagatcaggattccgcagtcagcctcgccgcctacaactgcacgtcctactttctctccgaactccgggtaattacagctctcattgccatctgttccaaaatttacaacttcgtgtccaagacttttcacatagtccatgatgataaatttcaattctgttgctgcatgatcgtttccaattgcgattttcatttttaatgactcctttttctttctatctgtacggtctgatgccgttatttacctattttgcttcttccgatatctggcatagaaaaataaaacgattttttccagataccgttttaatacgatctggatctcctctttcggatggatcggtttcaccagaatggttctgattccggcaagattggctccgtaaacatccgtaaaaatctgatcgccgacgaaaatggtattcgtggcatccgttcccatctcctgcattgccctgcggtaattgcccggtttcggctttcctgctttataaatataagaaacatgtaccgcatcattgaacatttttacgcgcggttctttgttgttggacaacagcatacactgaaaccccaattcctttaaatgtgcaaataaagcacatgcccgctcgtctgccggtgcaccatgcggcaccagtgtattatcaatatcaaaaatgattccacgatagccctcctcatagagtctgtcaaaatcaatcacatatgtggaatctaaatattctccgggataaaatttttccaacatgaatgtttgtccttttcactttctttttcgcagaaaaataccgtatgaatttcatacggtatcataaatcatttataaccagaagttttcttcttctcttacctgtttcagcttctccgtagatgcaaacgcatcgtcaccaacaaagaactgatactgctgcaatacctgatcttttttcaaatctgacaatgctttttccacatccagctttgaaatatcactgtcgacgcctttcaaatcgtaagacgcatcgggctgatattttgcattaaaatcggcaactccgtaatcttctttctgtgctgccggtatctgttcgacttttgcatccgtactgtcattctgttccacagtacctgttaccggtatctgctcgctctcccttgcctcctgaatctgctggcttcgaacttcatttatctttatggaattgtaatcataaaatcccgcgcctgtgcggatccccgatatattcatacaatcttctccactaaaacaatatcatgaacattcaatgctgagcttcgctactataaacgcaactctgttcttcatgatataatatcgacaaatctgttttagaacttaacccctatttatcaagcatctttttcaattcactcataaaagtattcacatccttaaattcacggtaaacagatgcaaaacgtacatatgcaacggaatcgagattcttgatcttatccattacgatctctccgatcaatgtacttgggatttctttttcctctctgttaaagatctctgtttcaacttcatcgacaagctgattgatctgattcacagaaatcggtctcttatggcatgctcttaatacaccggcttcgatcttggaacgatcatactgttcacgggcattatccttcttaatgacgatgagtggaatggtctccactttctcgtatgtcgtaaatctcttcccacaatcatcacaaagtcttcttcggcggatggaattattatcatctgccggtcttgagtcaatgactcttgtgttttcgctgctgcaaaaaggacacttcataatcactacctccaacccattaacccctattactttctagtatatatgtcctttttgcgattgtcaacgaaatattttttaagatatacttctgtaaatttgtaccagttttatgcaaggatttcctttgcgagttcttccattttggcaacatctgtgtctttcattgtggatttgatgctcacaacattctcacatacgtttacctctttcaggccttccaaaatgcctttcatgcctcttgctgcgcaaggtgcccaggaaccgttctcgatcagtccgaaagtacgtttctggaggttcttatgtacaaggcggtgcaggaaatcttccatcggaggaaatacccctgcatcataggaagctgctgcaagaatgatctttccatagcggaaagcatctgcaactgcctctgccatatcatctctggtcagatccataaatactaccttggatgctccgtttgcacggagtacttctaccattttttcagcggctgcttttgtatttccatgaatggatgcgcaggcaactaaaacaccgtcctcttccggctcatagctgctccatgtaagatactttccgatataaaaaccgagattttctttcaaaaccggtccatgcagcgggcagatcgtctgaatgtctaacgctgccgcttttttgagcagtgtctgaacctgcacaccgtattttccaacgatattgataaaatatcttctcgcctcgtctgtccactcttcctctgcgctcaacgcaccgaattttccaaatccgtctgcggagaaaaggattttttccgtttcttcatattccaccatgacctccggccagtgtaccatcggtgccatcacaaaatgcagcttatgtgttccgagctctaatgtatcgccctcttttaccacaaggcagcgctcttctaaatgtgcgatatcaaaaaactgtggcagcatcgcttttgcctttgcgctcagtacaagctgtgcctgtgggaatttgtctgccgcacgtttgatatttgccgcatgatccggctctaaatgggaaatgacaagatagtctaccgttcttccgtttaacacattctcaagatttgcaaaccactcgtctgttttccgctcatcaatggtatccataaccgcaactttttcatccaggatcacataggaattataagaaactccgtttgggatctggtactggctctcgaataaatctaatgtggtatcgtctgctccgatatactttactgcttctgaaatataggtatctttcataatggcctccatatgtttttatcatctaataataggaattattactgacatcaagataatactttgtgatgaaaatgtcaatgtttttccttttcattatgcttatttttatactacaaaatcttcgttgtccacttcgagcagtcccagacttcattgacaatatcctgatagaattccggttcatgacagatcagaaggatactgccgcggtattcctgcaacgcgcgctttaattcatccttcgcgtcgacatccagatggttggtcggctcgtctaagagcagaacattggtcgatttattgatcaatttgcagagtcttacttttgcctgctcgccaccgctcaacacgcggacaagactttcgatatgtttggtcgtaagtccgcattttgcaagggcagaacgcacttcgtactggctgaaagacgggaattcttcccaaatctcatcgatacaggtgttcctgttctcgcctttgatctcctgctcaaaatatccgatctctaaattctcgccgagttccacagaaccgccaagcgatgggatcaatcctaaaatactctttaacagtgtcgtcttaccgattccatttgcgccgacaagtgcgattttatgtccacgctccatggagatatttaacggttttgacagcggttcgtcatatccgatcacaaggtctttcgtctcgaaaatatagcgtcccggtgttcttccgagtttgaaattaaattccggcttcggacgctcggcagcaagctcaatgacatccattttgtctaacttcttctggcgggacattgccatatttcttgtggcaacacgcgctttgttccgggcgacaaaatcctttaactcactgatctcctgctgctgtttgcggtaagctgcctctaactgggactttttcacctcatagacttcctgaaacttatcgtaatccccgacataccggtccagacgctgattttccatatggtaaataatattcacaacgtcattcaaaaacggaatatcgtgagagattaagataaacgcattctcatactcctgcagataacgtttcaaccacgcgatgtgctctgcgtcaagatagttcgtcggctcgtctaaaagaagaatgtccggtttttccagcaaaagctttgccagaagaactttcatacgctgtccgccgcttaaatccgtgacatcatgagacagtccaagctcaagcagtccaagcgctctcgccacttcctccaccttcgtgtcaatgatgtaaaaatcgtgcatggtcaatgtatcctggatcacaccgagttcttccatcatcgcatccatctcgtccggtgccgcctcaccaagcctgtcacagatttggttcatgttttcttcgagttcaaacaaccatgcgaacgccgattttaacacactctcgattgtcatgcctttggtcagtgtggagtgctggtcgagataaccgacacggacgtttttcgcccattccacttttccctcgtccggcataagctttccggtcacgatattcataaatgtggattttccctcgccgttggcgccgactaatccgatgtgttctcccttcaaaagccggaaagacacgtcattaaaaattgccctgtcaccaaatccgtgtgtcaggtgttccacgtttaaaatactcatactgaatcctttcgtttttaattacattgttcaatttttcacaatttgctctactctggtgggaagtttcgcagttatttttttacttgtacaacatcttcttcgtctttttcaggacatggaaatatgccgggaataaaaatgcatccgcaaagatccatgccaccggacttgcaaagcacgctgccacgtagccgaaaacaggcacaaacgcaaatccgaccagtgttcttgcaaccatctcaaacacacccgccaaaatagcaaatttgctgtagcccattccctggatcaggaaacgcacgatattaacaaatgccagtggaatatagaatgcactgttgatcaataaaaacagtcctgcgttggaaacgacttccggctctgcctctccgacaaagaagcctgccagtgccccacggaagaagatcataatgacaaatgccagcaccgcatacgcacatccgagaatggacgccgcctttaaacctccggagacacgatccagtttttttgccccgacattctgaccgccataggttgccatcgtagatcctaacgcatcaaacggacagcagaaaaacattccgatcttgcttccggctgtcattgcggcaaccgcatgagagccaagggagttgaccgcactctgtaagataacgcttccgatcgccgtgatggaatactgcagtcccatcggaacacccattccgcacagtgtcatcatgtacgttttatttacctgcatttcctctttttccggatgcagtatctcaaaatgcctgatactgtaaataagacatcccacaccggagatcagctgtgagatcaccgtcgcccacgcagcaccttccacaccggttccgagcactacgataaaaaacagatccagtccgatattaatgaccgctgcgatcaccagaaacacgaccggtgtcctgctgtcccccatggaacggataattcccgaaaccagattgtacagataggtgaccggaatcccccagaaaatgatcacaatgtaacggtatgcaccgtcaatgatattttccggcgtgcgcatcagctccagaatcggcatacagaaaatgactgtcataatcgtcatgaccactgcaaaaattgcggagaggtaaatggcattcatcataaatccacgcatgcccttatagtctcctgcgccgaatttgtgtgctaaaggaattgcgaatccgttgcacactcccatacagaatccaatgatcaggaagttgacggagcctgtagaacctactgctgcaaggtcatctactccgaggaaacgtcctacgatcaacgtatccatcagattgtaaaactgctgaaataaaaatccaaacaaaagtggtacggaaaatccaagaatcagcttcattggcgatccgtttgtcatatccttcgtcatatctttttccctcgaaaaaattgtggtgatatcacatatcaccacaataagtattaaaaacttcaaaaaacgtatccgtcttcatcccggaacctgtctcaagttccagattctcccagagttcttcgttgatattcgaactcagggaagaaacaaatccattgtattcatcatcaaaagcttccttttctcttttgtctacaatattggctttgttcgcctctgtcagctcctgattgtatttgttcaggcatttaatgaaataaaagcctccatccactgtgatcttaccggaaacctcatcattttccatctgaaatgcgatctcttctactgcagccgggagatcatcccttgaaatatttacctgaatgctgccaagctcattataattattggcgagtgttgcaaaatcttctccctgggctaatctggatgcgatctcatttgcccggctctcatccgaaacaaaaatctgcatgatctccatcacccgtgcctcatcatcgctgacctcctcattcaccgcttttgtgagtgagtggtacactttctgtgccagcgcataatgctcatagtactctttgatgtcactctccgaaacgcccatataggcagtctcctcctccgtgagcgaggcaaagtactcctctgccgcctgagcggtcttttccttttcttcttcggaaagttccatctctttttcctttgcaagctggtctaagcagaccacctgtgccagctcccgcattgtgatatttttcacatagttttccagggaactgtctccaaaatcatgctgccagagatcgagtccataggctgttccgtaaatattctggtagttcaccagatataccttcgcctctttcagcccgcaggacacatttccaatgcggaatacctgacggttgttcaatgtgtttgagacgatcacttccttatttcctatcttgcatcctgtgagcagaaaggaaaagcagagcagacatatcagtgtcattttttttctgttttttttcatgctgttcatttaagcttccatagcttttaaaatgcttctcgcaacagagattccgtttgcggatgcctgctgcagaccacgggttaccgatgctccgtcaccgatggcacgaagaccttttacgcttgtctcaaagtctttgtttacaacaaccttgttcgagtagaattttacttcaacaccatataataaagtctcatcacttgcaatacccggtgttaccttatcaagtgcaaggatcatctcctcgatatccaccataatacgatgtgggaatacaagggaaagatctccaggtactgcatcctttaaagtaggaatcaggttatttctgcagagacgctcctctgtcgttcttcttcctcttctgaaatcaccgaaggtctgtaccagaatttttccatcgcagagcatattggaaagctgtgcgatctgcttgccgtattcgatcggtgttttgaatggctttgtaaaattcttggatacaaggattgcaaagttggtattgtttgtctttaaatctttggatttgtaagcgtgtccgtttacaactgcaagtccgttgtcgtagtactctgtcgcaacttcaccggatggattcgtacagaaggtacgtactttatcgtcaaatgtcggtgtatggtaaactaattttgcctcgtaaaggttatcatttaagaattccataacctcgtcacgcacttccacacggacaccgatatctaccgtaccgacctgcgtctcgatcccatgaccattacagatgtgtgagaaccagtctgctccctcacgtccgactgccgaaacaacctcttttgcatggtatgtttcatctttgtctgtcacaagtccttttacctggccatcttcaatgatgatatctttgaccatggtattgaattccatctcaacaccctgctctaacagatgctcctgcaatctggaataaatcttgtatccttcctctgttccaaggtgacggattggacattcgatcagttttaagtttgctgtgattgcttttctacggatctcgcggatttctttttctttatccacaccgtaaacttttgtatctgctccgaatttcaagtaaatatcatccgattcttttaataacgcaactgtctcgtcatatcctaaaatctctggaagatttccacctacatccggagataaagataattttccatcggagaatgctccggctccggcaaatccggtcgtgatggaacatggctgacagcctacacatacttttgtctttctctttggacactgtctgttctcgatacggcgtcctttttcaatcattaaaattttcaggtctttgttggcatggatcagttcatatgcacagaaaataccggaaggacctgccccaataataatcacatcataatttttcatgtagttttctccttgttataaaatgcttttttacagttttttgcactgtaaaatggcttactcgttctgtttgctttgcaaactttttgagtataataaactatttttcgtttgtcaatcctattttcaaaaattgttgaagtaataaattgttgaaataagtaaccattcagcccccattcgtaagtttatgaaagctgccttggtttgaatcgttacaaacctaagcttccacgatcagatatctgccatccgggagggcaaaaacttcgcttgcctcctccagatccctgagtgacattccctcgatatcagccccctgatcttcgaaataagcttttacctctttcagattcttacagacgaccgccatgcagtcctctaaaaattcctctgcctcttccggtgtctctgcgaccggctccgggaatagctgttcctgatgcgccagaaaatattctaaacatgtctcatcatattgcattttatttgctcctctcctcatatgtgttgttgataatttctaaattttaatttaggatataagagaatttagaaatcatccaatctactatttcatgcagtttaccatagatagggatcgattccaagcttttgcagctccttataaatgcgtgcaaccggaagtccgaccacattattgtaatcaccttcgatcccttcaatataaatggcacattttccctgaatcccataggcaccggctttatccatcggctctccggtcgccacataacggtcgatctcaggttccgacaacggcttcatggtaacttctgttttctcgtaaaaggtatgtgcgcccactcgtccgtttttatccagaaacacaaacgtaacgcctgtatacacggcatgttttcttcccgacagaagtgtgagcatccgctttgcatcggcttcatcttttggctttccaaggatggtatcatcacatgcaacgacggtgtctgccccgatcactaagatatcctgcggtgtcatcagttccccatgtccgctctcatatgtttttaccattgctgcgacctctgtcgctttctgctcggaaagctccatcacaacctcctccggcgcgcttttcgagataacttcctcccctttcgccgggcagatttcaaattccagtccgatctgttctaacaattcttttcttctcggcgatgccgaggcaagtatgatctgtcccataaatttcctcacttaaccgtttactttatcttgacaagacaccgttttttgaaaaatgaaatgccatagcatagaatctgatcataatcatcttcatactcctttgcatacagacgttcatctatctgttgcaacgcagtattacatgtactttccagtttttcctgatttttcgtgtattttgcttcaaaaatcgcaacacgtccattaaccggatcatatacgaccacatcactacgcccttcgccatgctccttattcgaatccaccatatatccggcacctgtaaagattcctgcaagaaacgcatgataaaaatcctctttataatcgtgataactgattgtgcgtcgtaaaagaatattcatttcttttgtcagattcacactgtcaccattccacactgcatcaaacaataaagtccgattccattttctggtactgtcatcaaaccactgtataaccgtcgtttcaaatatatccctgatttcttcattcggtatcataagtgcaatcgcaccgtcaggcagcacctcatccgtttgttcattccgcgcttttgtgaggtatcctgtcagatacagcatactccacaggttatcctccgaagaatgtaaataatcgtaagtcagattttcatccacacgctgaacaattgtttctccagccattaaattttccagcttcttcgtgatgctgcttcctgaatgatcgataaaagaacgaataattgcattatcgctggtatttttccaataactgaccggcttagcctgtggattgtgctgcagctccagcagataattcatcacatcccacggacaataaacatcaaagtcaccaaagtgatatccgtcataccattttcggatattttccgcctgatcttctgtctctgcatctgctaaaatctgatccacctcgctctggacaaagccaaagtattcattcaggcgtgaatctgtgatagtgtcagacacaaaattattggttcctgtaaaaatactttctttagcaattttcagacatcctgtgacaacagcaaaacaaagtgcctgattatctttcaaagcctgcaatagtcctttcatgacatctaacatctcgttgtagtaaccatgcgcatttgcctttgcaaccggaacatcatactcatctatcaaaagtactactgccttaccataatgctgctgcatcatagtcgtcaaaagaacaagactgcttttcacttctttttccgaaccacatccatgcgcaatatttgtaaacgttttcttttgaaactccgttacatgactgtcttcaagcagataaagatgtttgttatacagatcggcaaacaccattgtcagcatatcgtatgcacttgtaaagttcagaccatccacctgccggaatgatacggaaaccgtcggacattgattcatccacttgctgcataattcactctggcgtgcaatctcaagaccttcaaatagtttccgactgttttttcgaatatcaaaaaagctttctagcatactcattccgagtgtttttccaaatcgacgtggtcgggtgatcaacgtcacttctgcttctgttttgagaagttcctcgatcagaccagttttatcaacataataaaatccattattgcggattttttcaaaattagaaataccaaccgggatgtttaaggctttcatttttgcgactccttcctccgttctcatgatttctatgataccatgaatcacttatgcacacaagaaaatatcgtctgattgctctatacgatcgctctatacgaaaatcaccggaatcattaagactccagtgatcttcgtgcatacatttattcaattgaaatcagcttttctaaccggaacgagtagatcagaatctccttcaccttcagtttccgggtggcaaaaacccgctccaacgcatccgcataaagctttaactgtgttgcataacggtcaatcagctcctgcgcagtatccacacgatctgtcttgtaatccaggactatgattccgtcatcctcaatccagaaaacatcaatgattccctgaattaaagttaaatcttcctcatgcatatgattttcccgcgacacattttctaacacaatttcctgttgtgcattttcagtctgcacctcattttctatcatctgcgcacctgctccgaaaccataattttccagttcttcttccgtaaatcccatgacaaatggtttctcacggtaaagcgctcccatgcgctgtgcgagagccatccgctttcctgtttccgaggaaacaaaatctgccacaatccgctctttcacaagtgtgcgcatatccgcagtgatcttctcctctttttccatagcctccatctgttcctgcacgcttttttctgaggcaaaatcgtagcactccatgacgcggtgtactgcggttcctctcaacgcaccacggtttgctgtatttgattttattttctgttctgctttactttctgcttcctgccctgcatcctgtgccttattttgtgcctcctgttccacacttccctgtctctggataaaaagagggatcgttggtgtcacaggttcttccaaaaatgccgggaccgtctcctcctgttctgcctcaaatttttcacgcattgcacggtgctttaattcagatacggaatatttgtttttcctcaaaacgtcaacctgatatggataacgctgcaaaaatcgctgttttaactgtccaaccagctgtgtgtccgccgcttcaatctcttcgatccgctctgtcagatcttcattttgctctaactggttttccacttcgtctaagacaagctctgccgcttccacgatccggaccgggtatttgtccccataggaaagcactgccggaagtatccagtccagataaccggaagccccttctcttgtaaggtaggaaagcggtctgtctgctgctttcgaaagattcgcctgctgcctgaaaaattctagtttttccggggcatcctttaatgtcccggtgagaatgagcttttcttttgcacgggttaaggcaacgtatagcacacgaagttcctctccgagattttccagatcgatctgctttgcaatcgccttctttgcgatagtcggtgatttgatacgcttttttccgtccatgtagtcaagaccaataccaagttccgggtgaagcaccattttgctccgtgtgtcctgtttattgaaatttttgcccataccgctcacgatcacaattgggaactcaagacctttgctcttatggatactcataattcggacaacgtcctcgttttccccgaccatgtctgcctcaccgaaatccacatcatatttctgcagttcatcaatgtaacgcacaaagtgaaacagtcccttgtaactcgttttctcgtaggctgcggctttttccaaaagcatgtttaaattcgccgttcttctgtttcctgccggcattgccgccacataatgaccgtatccggtctcgcgcaggatgatctcgatcagctcatggatcggagtgtccgggacgagctgccgtaattgcttgtattttttataaaatttgagtaatttccggtgagcggttatctctatatgattttctgttttctcatccgcgtttcttccctgcttccgatctgcctctgaatctgaaatttctttttgcccgtcctcttcataaagtccttctgccagttcaagcaccgcttcatgaaaaggcacactgccatcttcaagccttaacaccgcaagctcctcatcggtaagccctgccatcggcgagcggagcactgccgccatcggaatatcctgccttgggttatccaaaagcctcagcatggacagtaccgtctgcacttccaccgtggaaaaataaccggttgaagaaaccgtgtgcgccgggattccatttccgttcagcacttccacaagcgaatccgcccagccggacaggctacggagcaaaattacaatatcggagtaatgcgccgcccgaagtgttccggctgccttgtccgtgacctgctgcgttttcatcagatgcttgatttcttctgccacaattttcgcttccagtgtctttttatccgtaagttcggtgtcctccaataattcgtcgttgctgtctgcaagcaggatctccgggatgaagtccgcgctgacaggatagcttgcccccggatacagtgcagcctccgcatcatactccacatttccaagactccgcgccataattttataaaaaatatcgtttgtgcaggtcaagacttcctctctgcttcggaagtttttgtgcaggtcgatacgctgcgtggtgctctcttccagcgaataggaatcgtattttttcatgaaaagttccggtcttgcgagacggaatcggtaaatactctgctttacatccccaaccatgaaaatattattttccccacgctcctctctggaaatggagcgaagcagtgtctcctgcacttcgttgctgtcctgatactcgtcgatcatgatctcctcaaaggtatcccggaactcttccgcagtctttttcgccttctccgtctcctcatccacaaggatctgcaatgcaaaatgttccacatcatggaaatccaccagatttttccggcgttttgcggctgcaaactcatctgcaaactgctttgtgagacggacaacctcctctaacatcggctccgtgcgctctaactgctcgatcatcatctccggcgaacagaaaaaatattgtctgcagagttttttcaccacatcctttgcctgctccctgagacttttcaccagctctaatttatcgggatctccctcaaaccctctgctgctcgcaagtctgtcgtatttgatatcggaaagcgccccggacagttcacagaaagaggttagtcttgacaaaccatcatatttttccagatcactctgcactgctttctcgtacatatccggtccgtcatcctgctgtgtgattgcaagcgcctgctttaagagctgttcacagtcttttaagacaaaacagatattttccgtgagcggagcaagccattctgcgcggtctaactcctccctggtttcgatgcggtaggctcccacaaacgaatccagccatttttccggccacggataacttctggaaaactcatataactgaaggatcatctcatttaatgcagcatcggttcttcccgaagcatagccctccacaaaatcggaaaatgcttccgaaggctcctcataattttgttccaaaactctgccaagaacatcctcgcgcagtaattttaactcaccctcatccccgatacggaaattcggttccagatcgatctcatgaaaatgattgcgcaccacatacagacagaagctgtcgatggtcgtgatctgtgcattgtgaatcaaggtcaactgccttaacagatgctcattccccggctgttcgtctaacgctttctcaatcgcatttccgattcgctcccgcatctctgccgctgccgcattggtaaacgtcacgatcagcagatggtcaatgtcgaccggatgatttttgtctgttatgattttcacgatccgctctactaaaacagcggtctttccagaacctgctgccgcagataccaatatatttcgatttcttaagtcaatgaccttctgctgctctgtggtccatgaaactcccatatttctcactcctgttatttactgttcctgcttttcgttttccatacgctttaatatctcgtccgcactgtcaaatttttccagtttatgataggaataacccggcatccgggtgtcaaaaccgcagacggtatggtatggacagtaatcacagccactttttccgtccagcgagtatggatgaatcgaaatatctccggcaaagatttttttcccggtctctttgattttctcctgtacataatcagacatcacagaaaaatcgtaagtactggcaaccttggaagatgcttttaagcttccgtccgttttttttccgattgggatgaccgaagaatttccggcaaaatctgaatccatcgcctcatagatttccggatcatcgttcaccagaccatttaattttaactgctccaaaacgctgtttcgtatttctgcctctgtctcatttccaagtccgtctactatcggattttgaatgtgatagtagaaaatacccgccggttccgcttttttgcccggatggcgtttttcctctaattccaatgccgcattcatatagaccacaagctgtaattgcagtccgtgatacagattgacgagtgaaaaactcgtgtttcccgatttataatcaataatcttcacataaactttatccgacgtctcgtaagtgtccacacggtcaatcctgccgagcaggttcattttttcctcatcactcagctgaaaacggatggcgtccaatttatctgcccgcgaaaaggacacctcaaaatcactcggcacaaattttcccttctggatctgggtggtaagtgcccacaccgtgcgcttgatggtctggcgcatccgaccggtcaggtaacggtttctcacgttctcaaacgctccggcatttttgcacccggcaatcgcgtcattcatgctctcctctataaatgtctcctgcacatcctccgggatgttaaaccaggtgtactctgatttttccacacgtctggaaaaatgttcaagcgcatcatggtaaatatttcccatgtccacgcttgcaaactctaaaagctgacgctcctttaggcgtaaaccgtaattcagataatgcgcgtaggcacacgccgcaaaacgctccagtcttgtgacgctgttctccaacacggttccataaagtgcctgcgtcactgcgtggctgattggctcatcgctgtgcacttcgtaggcagtttttaaaagttttttcgtttccggcttccactcggaatctgtgaggtagaattttgagagagcattccataattttcttttttctacctgagaaaaatcagatgccctgtcattatcctgcagtccctccaggaaaaacgccatgctgctcttcggcgtcatgatgcagtccgcagaagttgtctcctcgatttcctccaccgttttctccgggaacattttcaagagcgttccaacaaaatacgaccttctaagtgcttttccgtccgcattcacttttgaaaaagtcacatataaaaaatcagatggcttcgtcacattcagatatagataaaagcgctggatgaacactttttcacgcgcacccggtgcaagttccagatgacatgccaccattttctcacgttcaaactgcgagatgatacctccggcattgcccgctttcggcacaacaccgtcattgacaccgatgaaaaataagattttgatatggttcaatctggttcgctcgatgtcaccgatcgtcactttatcatttcccggcgggatcacgccgactcttgcagcctcaaatccggcgtctaaaatatccgcatactctttgaccggaagcacttcgtctcccaggaagtccacaaccttatcaaacagatccatgacaattttgtaaatctgggcgtactctttcgccttgacctgattgccctgccgttcaaattccagttctttttgttttaatttttgttctatttctaatttttcaattaattcatacaacacagtggtctcgtcacgcacagtctttccctgtgtgaacgcttccgataacggtgcaaagaagccataaatcttttcccgcacctcattcatttctgtgaggttctctttttcggtatcatcgaacacaaacgtccactgtttttcccatttttttctgccgcgtatccctttggcaagcacatagttttccagcagatcgatctgctgctctgtgatatcggtcagaccgcagcgcagaaaacggaacacgctctcataagagaaatcaagttccaccacctcaagcaccgcacggataaactcgataaaaggatgaaacagaatggttctcgtctggtcgagaaagtacggaatatcatacgctgcaaaaatctcatccacatagttgtcgtaaagactgacgtccccggtcaccactgcgatatccttataacagtactgtttctcacgcacaaatttcgtgatctcacgcgccacaaagtgaagctcttccctcggatttttaaggctcacgatccgcagttcatcctccttctgccgccatttatgataatacggtcgaaacagattctgctccatgaagtacagggatggagcatttttatatctgtgattttttccatcggataacacaacaggctcctccaccgtgacatgaagttcctctgccattttcatcagaaccgaaaccgtctttttactcatggaaaaaagttcctgctcgcccctgcaatggtaaaaatcctcgcctgcatccatcgtcacggagacaatgatacgctctgataacactaaaagttttctaagaagctgattctgtatcggtgtaaaaccggtaaattcgtcaaacacaatcacgctgtcttttataatattcgaatcctctgcggcatcgcacaatagcgataacacttcctcagaggtgatatactgcccttgcagatattcagaaaaactgtgatacatgaccgagatatcctgcattttcaggcgcaatgtctccccgacatcctccgtctccaaaaatgtatccaatttttctggtgacacgttatactgcgtcagctcggaaatgagggatttcacctcactgatgtaccccatccggtttaagttaccgcccagcacacttaagtttttcttctgctcccctgcaagcttgcggagcaccagattctttccggtctcctccaacacgcgcaggttctgtttcccaagctcgtcaaacacacggtatgcaaggcgcgcaaaacttaacacatccacgttcatgatagcatgtgacttttcaagccgcacaagctcgcgctgtgtctgcatggtgaactgctccggcacaagcaccagataatttttctccggatgctctgccgcctcttttagtatgttcctatataaataggatgattttccacttcctgaatttccgaaaataaattgcagcgacatgtttttccctaacttttttcaaattctaattttcgttttctgttccttttcatagtacatcattctatcttttttgactagaataaagttcccggcttatgatgttttccatcagaaaatttctccaaaagaatggaacaaaaaagctgccatacaatccgggaatttctcctttcagtacgacagccgtaatcacagatctctatttctgtgcttttgtctttttcttccggtaaccattgatgtcatattttctttcatactcatcaaagtatgccatgtaagtgtcattctttaactcgcggacactctttaaatactcatgggtatcaaagtctgctgcctcaagctcgatcatggcaactgcgatgttcgagcagtgtgctgcgattcgttccaggttcgtcagcagatcattaaacgcaaatccctgcttcatctcgcattttccggtgcggagtcttgcgatatgacgcagtttcagttcatcgcagaggataccgatcagttcgcggagtggttctacttttgccgccatctcaaggtcatccgcacagaatgcatccaccgcaagactgacacactcttttactgcattctccagcacatccagctcatactgtgcctcatccgaaaatgcaattttcttctcgttcagctccgccgcaacctctgagatattcaccgcatggtcgcccagacgttcgaaatcactcactgtatgcaaaaacttggatacctgcttcgcctggcttccattcatctcatgcgtggacatctgcatcagataggttcccagcttatcctcatatttatcgatcagcgtttccttttcctgtaccttattaaacttttctgtcgaatacacaaggaacaggcttaacgcacgtaaaatattctttcttgccttctttgccatgccgttcatcgcaagatggctctgcgtgatcgcaagatccgggtaagcaaggaaacgctcctcgagcagatcgaagtctgcctgatcctcctcgtcctctggcgaatcttttacaacaagataaacaattttttcaatccatttgataaatggaagaagtactaaaatcgttgccgcacggaaaaccgtgtttaacattgcaatcagtaccgggctcatggtggcattcataaacgggaaatgcaccacagcattgacagaatagaatacaattgaccagaacagcatgccgaacagatcgttaaacagatagatcagggctgttctcttaccatttttgttcgttccgatcgaggagagcagaaccggacaggctgcgccgacaccaatacccatggtaataggaagcgccgctgcaaaagtgattgttccactcatggacaacgcctgaaggataccgactgaggcagatgcactctgcaataccgctgtaaataaaatacctgccagtatacctgccgccggatttttaaacattgtcaatacattcacaaaatgctcattatcttttaatggtgcaactgccccactcatggtctgcatccccaccatcaggatggagaacccaagcataatgtcaccgacatttttaaagccggatttttttacaaacattttaaagataataccaatgatcgccacgatcgctgagatagtcgccgtggacagcagctgtgcaatcccgttcgaaccgtcaatgtacgacagacacaaaatccagcctgtcacactcgttccgatgttggctcccatgatgataccgatcgcctgcgcaaccttcatcattccggaatttacgaagccgacaaccataacagtcgttgcggaggaggactggatgatcgctgtcacagcagttccaagcagcactcctttcaacggtgtgttcgtcagcttataaagaaccagctccagcttattgcccgctactttcttcagtccgtcccccatcagggacataccaaaaaggaacagtgccactccgctgagcagcgataaaataatagtaaatgttgtcatttgtactcctaaccacgttatacatcctaacgtatccctgtctgcaattttatttacaaactttttacatgatttttacatttaaccgacatttcttattatactgtacctcatggcaaaatcacaatcattttatttctattttaaaattttttacatttcgcctaggaaaataccgttttcagacaaaattattatcacttttttatctattctcatttagtgagagcagattcagccttttttgtctgcacctctccgctcaatccctgttttcttatagtattctgccttatcctcatacatgcgcttctcagcttcctgcagaagttcatccagatgtgtgtccgccctgtcctgccagatcactcccactgcgatatttacgtccttctcagctgtcagacactctaactgccttatgcgttccgccaacgtgtcctgatcgatctgcgcgcacaatacaagcagctcatctcccccgatacggaatacgccgtaatcgccaaacacttgctccagacatgcaccggctctaaggatcaggtcatcccctgccttatgtcccagtgtgtcattcacaccctttaaaccagtaacgtcacaataaactacgccaacgctctgctccggatcgatctgtctcacatacttttccatcgcaaagcggtttccaagctgagtcagcgcatccttatagcttagatcttccagacgcctcatcagattcctgcgtctgatgcaggacttgagaaaagaacccatgatctgaagcatatccgacgtatattccaatgaaaatgccggcggattgtcaactccgtaaaaagcaatgactttttccgcatcataaattggcatggcaacaatggaatggatcttctgccgcttcagattctcatattgtaacggatcgctcaggcgcatctcctcaatatccggtatctggacacattttccctcctcaaaaatgtgataccagttctcacagatctccggcggaagattctggagattgtcgatctccggtggcactcccggcgccgtccattcatatgtattatcatccctgccatctctgttcttctcaaaaatatatgttctctctccgttcagcacttttccgagatattccagaataatacggatcgtctcgtccggcgactcgacagaaagcgcatccttcaatgcctcgttgacaaaggactccatatccctgtacttctggatcatcttgtcctgtgaacgctcctcgctgatatctatactgatctcgatccggtactttttatttgtgacaggatcttccaccagggtatctttcaacatcatgtatttatcgatcaccggattataataacgccactcgacaaactttccggcacaaagcctgtcattattgcacataccacagggaacagaagatttctgcagcacctcgtagcacttcatccctttcacatcatctatggactgtaatccatacacctctaacaatttgcggttcatataaacaagctcatctgtctctatgtctgttgcgtacacgtactcatccagattatctaaaaacttccagataacttctatttcgttcattctttatactccgtttcatgcagatatgaaatttctataaaaatctgtatagtaaaatagcacctcctgagaggtactatctcaccatacgccattattatgcggattacaaacaaactcttccataaacttctttttttcacagggttttccaaaaaaatacccctgaagataatctgcctgcagttctttcatcttaagatgccagtcttctttttcaattccttccacacagatgtggatgccgatgctgtgaaccatctcaatgatctttttaaacagctcgtaatcccgttcgcagctcattgcctttgctgtaaaatccttatccattttcacatagcccggattcatgtcactgatgcagtggagattggaatatccggttccaaaatcatcgatcacgaactgaatcccattttcctcaagcactttcctgaatttacaaaagaccggtgtcatatctatgaagccgctttcagtcatttctatgcagatgcggttcggtgtcagtccattgtccctgaccgcagtgagtatcttgtctgcaatctttccatgctcgatctgataataggaaatattcacgttcaccctgaattccggtatatattgctgtatctcacggcacatttttgctgcctcatttaacacaaaccttcccgccggaatgatcagtcctgacttttccagaagcggtatgaactcgaccggagacagccactccttgccttcctctgtcaccatggtataccgcatgagtgcttctgcaccgatcacacgcccggaaacacaatccacgatcggctgatagtatacttcaaaaccttcacacccgttagcgatggaatttctcagtgcacttatgattcttccattccgctggaatttctcgtaatcctcctgcctgtaaaaatagatgttattttttcccatccgttttgcctttttcagggaaaattcaaactttttgcggcattcctcgtagccttctgccacagtcgaggcatcgatcactcctgcagaagctgaaaatacaacttcatatttttcagagatgatgaattcgtctattttctcaccgatcttttttttgagctgtatggcatcatccatggaagtactgtcaagatccacgatcacatactgatctgcgaccagatgatagagtcgctgatttccggacaggcactctttcatacagtctgcaacactttttaacacataatcgccataattgctgccatgtgtttcattcaccgttgcaaaatcatcaattccaatatgcataagaaatccggtcgtcacaggtttcttctgtgaccgcagataagcacaaaattccattccgcctaaaagcccggtcacattatcagcccgccgctggtttccggtctcattcagacatcccaccagataccccggcttcccatcttcatcatcgatcactactccgcggcagttgacccataccggaagcccgtttttgtcgagccaccggtaatggatatcatgcaccttttcctttccatccatcacagcctgcatatgctttgcaaacatagtgcggtcttctttgtagacaacggacatgatctcctgctttacattcctcatatgtgtctcagagatcataaaccgatccagggctgactgggaaatttccatcttattgttcttgagatcgaacacatataggtaatcatccatgcattccgctatgatctccaataagatctctgctgtcagatctcctaatattccatatacatccttattcataaccagagaaccttcccttttcttttgcgcttatactcctgcgcatccagttgaatttatctggtccgatattattttttatgctttgcaactttaaatctgcggatcattgcacgtaaattatctgcttcgctgctcatctcttcacttgcagccgcacattcctctgaagtagctgaattcgtctgtaccacatcattgatctgctcgattccttcattgatctgatggatctctgctgtctgtgtctctaaggtgtctgcgatatttgtcacttcacttgtgatcgtttttgaattctctgccacttcctctaactgtgctgctgtttcctttgcaactatcatacctttttcaacagcattcacagagcgctcgatcagtgccgctgattcctttgccgcttctgcactctgatctgccaggacatttacctgatttgcaactactgcgaaaccttttcctgcctcaccggctcttgcagcctcaatagatgcgtttaaggcaagcaggttggtctgggatgcgatctcattgatcgtcgcaatgatcttgtcaatctcatgcgatgcatcattgatctcgttcatggagacaaccatctcctgcatctttccgttgctctcgatcagcgcctgtccaagctgttccacttttccgctgatctcctttgctgcctgtgaattgtttgccacctgttcggaaacaccggtaacggtagcggtcagttcctcgacaactgctgcctgattcgttgcgccgtctgcaagctcgttcgagctggatgccacctgttctgctccgttggatacctcatcggaaaccctctggattcctcttaccgtatcagacatgctgttctggaactccataaaggattgtaaaataccaacaaagtcccctctccactctacctctggctgtacatcaaaattgccctctgagaactgtttcatggagcggtcaatatcatcgacatacgttccaaggatacggatggacttacgcatgctgtgtgcaagtcttccgatctcgtcctcggagtggtagtccagctggctgtgcagatttccttccgtgagttccttcgccacgtcctcgatcgcatgtaatggttccagaatggtttcaagtaccatcctgctcactttctttgcgattgcccatgcaaggagcaggaagataatgatcactgcaataccggcaactgcacagaagatcgtgctctggacagccttacttctctgtttatcagtcaatgcatctaatttctttgaaatttctactaagctgtttaatgcaggggtacacttatttaagataccatcgacagcctgatcttccttaccggccttgatctcttccatgatctcatatccgatcgttccccagtccgtaaatgcacctttatattctgtataaagatcctctgtaatgacacctgtgccgtgtaaaacattcatctgtgtatctacgatcccgagaagctctttcaccttctcctcgtagctgtcgtaagtggattcgtcatcattcagcgccatttcacggatatttcttgctgctgtatttatattaattctgcatgtttttactgcctgatctgctgcgttgacattattgacataattcatcatattggcaaacagaatgcctattgcaataatagaaatcactcctgacagcagcatcatgttaatgacttttctataaccgtaactgattcttttctgcagatacatattttcaagttttgttttcattgtactcttttgtgacaacataaattgtattttcctttccattctaatatactttttttctttctctgatatattaatttttccagtctgacaatgtattaattgcctcgttttatttcactttttatctgttttttcttctaccctccacctgaaaaatctgtcaattttcttctagtttctcacattatagtctcatattttatgtctgtcaaaccttaaatgacttttttcaattatttgtttgaaaacgtttctaaattgtatttccgaccgcttcctttgcaaggcggtctgcttcttcattgccatccacaccggaatggccttttactttcacaaatttaatcctgattttattttttgcagactgcatataatcatagtaggcgatcgtgccctgcctgttccgtttccaggctccctctgcccacatctcgattcccatgtaatcgtaataaatcgtcacttccggaagtttcaactcgatcgcacgttctactgcagccatcgctcctaatatttctcctgaaacattgcgcatggatgccatctccgcatcgtttccgcttccctgcagcacttctttctctccattatgaatgagaaatccgccgtagccgtagacttttgtggcaatgttgtaagagccgtcgacaaaggcgtagactgccggattttgttcctgcttccctgtatctggtttttctgctttttcgctccgctttctggagctgccttctgcacccacgaaggcttccgcttcctcaagtgttttgaagcttttatatacggcacccggaaaaccgtctaccatttttttgcaatcatcccagctgttgtagattcccggaattttacctttttttaccgcgtagaattttgatgccatatacgctccttttctgattgatatttcattatgataattccagcctgcagcttcctctcatctgcagtggacattcgtaaacattttcgtccccatttcttccaatataggacaatgggcattttctgcaatcctctaatacaaaatctgccggaacatcaaactcgattatcgcttttttacttccttttgcctcattctcatgcctgatattgtcccagcttaatttctgtccgcatccctgacatttttcagtaccggttgcaactgcgcgtttgcatgtcggacaggcatagtactctttccctgtcatatcctttgtctctattacctctgatgggaactgtttgatcagttctgctcttaaatcgtcctgcattttttgtctcctgtattctaattttttatttaaagcatgtgatgtttgttgttatcgccattcttactcaccatcactgcaaatgccaacaacttattttatcacaacaatttttaaatttcactaacatttatatcagtatattgaaatattttctatgtaatgtgtcattgcaaaaattgtcgatttttcaaagtttttgcatttcagtgcataaactttattttttcaagaatttatgctatactcatgtcataaggaggtatatcaaatgattgatactcacgaactcaaaaaaagagatttatacctgaataagatcatagcatttcaagacaccgagccagtgaaggttgttaccggaatccgtagatgcggcaaatccagtctgttgaagttaatgacccttcatctgaaagaaactggtattactgacgatcagattctggaaatgaattttgaatcctacgcttataaaaatatgaccagcgattccttctacgaatatgtcaaacaacatatcgtaccaaataaaagaatgtacttcttttttgatgaagttcagcgtgtgcctgactgggaagatgctgttaactcttttcgtgtcgatttcaactgcgatatttatgtcacaggctcaaatgcctatatgctctcctctgaatatgccacctatttatctggaagatgcatagaaataaaaatgctgccgttatctttctctgaatttttaacattccatgattttgaaataagagagaccaaaagtgctttaggcggtacacgaaaacaggcttatgataaaatgggagaacattatgaactccgtgaagttttcgatgcatacatgcgatttggcggaatgccgggtatcgctgacataggtttagatcaggaaaaagcacttgtgctgcttgatggtatctactccaccgttatcatgcgagacattctcgaacgagaaaatcgcagaggtcaaaagcgggtcaccgaccccatcctcttaaaaaagatcactatgttccttgctgataacattggaaacaatatctctatttcttctatcggcaacaccttagtaaatgaaggacttctggaaaacaagaatcgaaaaggaaccccaagtgctcacacagttcagacatatataaatgcactgctggaatcatatttcttctacgacatcaaaagattcgatattaaaggaaaagaatttttacgcactcttggcaaatactacattgtcgatatcggactcagaaactatctgcttgggttcagagaccgtgacagcggtcatgcaatagagaatgttgtttactttgaactgcttcgtcgcggctatgatgtctctattggtaaaattgataatcttgaagtggattttattgcaacaaaagcagatgataaactttatgtccaggtcacggaatcaatgacaagtgaagatgttcgcaaaagagaattaacaccactccaaaaaatcaacgataactatgaaaaaatcgttctttccctgaatacaggaatggactcttcgtatgagggaataaaatctatcaacctcctcgactggctgatctcagaataaaacccaaaagcatcaaaaaaggaaccagagattttctctggttcctcaaaattataggatattcttcatgaaccggaattttacgcttcctgattcatattcgccagcttcgcagcctggtcggctgcgatacatgcatcgatgatctcctgaatatcaccattcatgatcttatctaatttgtaaagtgtcaggttgatacggtggtctgtcacacgtccctgtgggaagttgtaagttctgatcttttcagaacggtcaccggtaccgatctggctcttacgaagttcagcttctgcatcatgtgctttctgctgctctaagtcaaataactttgtacggagtaacgcaaacgcttttgccttgttctggatctgtgatttttcagtctggctgtagatcacgattccagttggaatatgtgttaaacggaccgcagagtctgtggtgttgacacactgtccacctgctcctgacgcacggcagacatcgatacggatatctttctcatcaatctgtacgtcaacatcttccgcctccggcatcacagctactgtgatggtagaggtatggatacgtccgccggattccgtctcaggcacacgctgtacacggtgcacaccggattcgtatttcataacggagtaagcacctgctcctgtgatcatgaatgtcacactcttcatgccgccgattccggtgtcgtcacattccatgatctctgttttccagttctttgtctctgcataatgctgatacatacggtaaatctctgccgcaaataacgcagcctcatctccaccggcaccggcacggatctccacgataacgtttttgtcatcgttcgggtcttttggcaaaagaaggatttttaattcattctctaattctgcgacacggttctttgcatcgtttaactcttcttttgcaagttcgcgcatctcttcgtcagattcttcctccaacatggcaagcgaatcctcgatgttctgcttgcactgtttgtattctttgtaagcctccacgatcggtaaaatatcgctctgctctttcatcagcttacggaaacgttccggattatttgccacatccggctcacttaattcactcatcaactcttcataacggatgagtaagtcctctaatttatcaaacatatttctccctcatttctgtctaatcaaatatcgtgatttcatcactcaataatttcgtcgttcgtcaaatgcaaataaatttgcattttcctctctttcgctcattatatttctacactctgatgccgctacaacatcccagtcacaaccctgtcatttcctgcaaggtcttttttcacacagacgtttgaaaatcctgcgtctgtcatcattttagatacatcttttccctgatcatacccaatctcaaacatcagagaaccgccagaattcagataatctttactctgttccacgatcttgcggtaaaagtaaagtccatcctcttttccatctaacgcctcgatcggttcaaacacctgtacctccggcatgagctgcggaatcacatccgttgggatataaggcggatttgacacgatcacatcaaacttctccgtgaccatctcaaaaaggtcactgcgttcaaaaagaaccggcacctcatttaattttgcattctcttttgcaacgttgaccgcctgcttggagatatcaactgcatatcctttcacgccctcaacgttatgtaaaatactgataataatacaaccggaaccggtacacatatcaagtactttcattcccggctttactgtttttaatgcttcctccacaagtgtctctgtatcctgtcttggaatcaggacattggaatttaccttaaacttaagtcccataaattccgtttctcccacaatatactgcaacgggatatgttctgcacgttttttgatggcaagttcatattccttcagcagatcatcaggaagatcatcttccatatgcatataataaaatttacggtctatcttacagcccatttccaaaagcagccatgcatctgttttcgcatctgcaatatgcgacagctccagcactttttctccatgggcaacagcttcccgatatgtcattcttatctcacgcccttctacttcatttcccggcggatttcttccacataaggtttccagtcaaaaacggcctccacagaggcaattccaacctcgatcatctcatcatccggttcctttgttgtcaaaccctgcagccataatcccggcttgctcaaaagattcacaactgcattatcgcttcttcctgccagccggataaattcataggatacacctgcgatcaccgggatcagaagcagacgcaaaaccacacggaggattggagaatccacgcggataaacataaaaaacaaaatgctgactaacattacgatcaaaagaaaacttgttccacagcgtttatgaaatctggaactttttctcacattatccacggtaagatccatgccatgttcaatgcagttaatacatttatgttctgcaccatggtacatataaacacgccggatatccttcatcagagagataagtgctacatatccgatgaaaatcaccagacggatcactccctctaacaatgcgatcacccactgggatgtaattactttctgaaacagagtcgataaataatatggaagcatcataaatactgccacagcaagaacaatcgataatacaaccgttccgcccatcatggcattttcctgcttcttctctttctgctcctgtctcctgcgctcttcttccgtcattggctcttttttcttcttatccacttcctcatcctcaaaaaaagaagcggaataggtcaatgtctgcattccgagtacaagcgactctataaaactgaatacacctcttaaaatcggcatatttcttattttcttatttctgatgatcccagtatattctgaaaccttcacttcaatctcatggtcaggctttctcactgcaacagcgtacttttcctgattcttcatcatcacgccttccatgacagcctgtccgccaattcctgaatatttcatttaaataaccatgtctttctcatagagtttccatgttctaaaaaaggttgagatttaataacctcaaccttatctgtaaccacttttttctatttgttgataccgtatttcttgttgaacttatcaatacgaccatcagctctgttagctttctgctgacctgtgtagaatggatggcatttagaacagatctcaacgtggatatcttcctttgttgatcctgtaacaaatgtatttccacagttacatgtaacagttgcctgataataatctggatggattccttctctcatgattttcacctcttctattcttatcgttgatttgttgcgcttgttctatactctttatgcccgtatacccgattcgcatatggcacttactgcaagaatatacacgatataaaaactgtccagaatctgtaaaagattctttatcccgataaacagcttttaaagtatagcatacgcatcatagtaaatcaagatatttttttaaataattctatttttctttaccattgcgatatattctttattattctttgtgcgggcgaacatatttaaaatattctccactgcctcatctgcacgcataccattgtaagccttgcgcatgatctccactgcctctaactcatccgggtcaagcagcaggtcttctcttctggttcctgactttacaatatcgattgccgggaacacacgtttttcggaaagtttgcggtcgagtacaagttccatgttaccggttcccttaaactcctcgaacacaacgtcgtccatcttacttccggtatctaccagtgctgttgcaagaacggtaaggcttccgccctctctcatatttctggctgcaccaaagaaacgttttggcatatgaagggctgccggatcaagaccaccggataacgtacgtccacttggtggaactgtgaggttgtatgcccttgcaagacgtgtgatactgtcgagcaggatcatgacatctttatgatgctccacgagacgttttgcacgctcaatgaccatctcagatactctcttatgatgttccggtaattcgtcaaatgtagaataaataacttctacattatccccttcaatcgcttccttgatatcggtaacttcctccggtctttcatcgatcagtaaaatgatcagatgcatgtccggattagatgctgtaaccgattttgcaatctcttttaacagagttgtcttacctgctttcggctgggaaacgatcataccacgctgtcccttaccgatcggtgagatcagatccacgatcctcattgcaacactgctgcccggtctctccaaacggattctctgattagggaaaatcggtgtgaggtcttcaaaattctttctctgctggatcacgcccggctgataaccgttgatcgttgtgatatataataatgcagagaacttctcctgctgtgttttgatccttgtgttaccgcagataatatcgcctgttttcaggttgaacttacggatctgggatggagacacataaacgtcattctcacccggcaggtaattgtcggaacggataaatccgaatccatcctgcataacctcaagaattccattcacagtgattccgctgtcaagattcttgatcgtatcatcctggcttgcttcctcacgctctccctcttttgatccctctttggctgattctgctgaatctgctctttttctctccggtttctcggaaggagctgactgttcctgttttttctccgattcttttgccgctttttctttttccttcttcgcatcctctgcaagcattgcttctacaagatcggctttcttcattgtggaagtgcttttaattcctcttgattttgctaaatcacgcaaaaccgttgctgataagctttcatatttttctctcattcaatgactccttaatcataattgtatcatttgggaacaacgtctgaatcgactaaatgaatctataactgcaatttattatacaacactttttacgaaataggaagtcctaattttcttgattaataaaaaaggaaatgttatcattactttcagagctttaaaacgaatatttacataaaggagacagttcatatcatggatttaaaagaaaaagcattagccatgcataaagagtggaatggcaaattagaaacgattgcaaaatcaaaggtcaactccagagaggaccttgcaattgcatacacaccgggcgttgccgaaccatgtaaagtcattgcagaagataaagaagcagcctacacttataccatgaaggcaaacactgttgccgtcatttccgacggaagtgctgtcttaggacttggcaatatcgggccatatgccgctatgcctgttatggaaggaaaatgtgttcttttcaaagaattcggcgatgtgaatgctgttccgatctgtttagacacacaggacaccgaagagatcattgcaaccatcaaaaatattgctcctgcattcggcggaatcaatcttgaggacatctccgctccgcgctgttttgagattgaggaacgtttaaaggcaatgctcgatatcccggtattccatgatgaccagcatggcactgcaatcgttgtccttgccggaatcatcaacggtctgcgtgtcactggcaagaaaaaagaagactgtaaagtcgttgtcaacggcgccggttctgcgggcgttgccatcaccaaactgctcctcacttacggtttcaaacatgtgactatgtgcgaccgcgaaggtatcattggaaaagattacccgaatttaaactggatgcagaaaaaaatgaccgaggtaacaaatttagaaaatgcttccggtacacttgccgatgcattaaagggcgctgatatttttgtcggggtttccgctccaaatatcgtaactcctgaaatggttgcctctatgaataaagattccattctttttgcaatggcaaatccagtaccggaaatcatgccggacgttgcaaaggcagccggtgcaagagttgttggaaccggaagaagtgatttcccgaaccaggtcaacaatgtgatcgcgttccctggcattttcaaaggtgccctggagggacgtgccacacagatcaccgaggaaatgaagcttgccgctgccgaagctctggcacatcttgtttccgacgaggaattaaacgatgaatttattatgccggaagctttcgacccgcgtgttgcagaggtggtaagccaggcagtaaaatcccatatcgtaaaataaacatggatatgtcagataaaaaattctggggagacaaaccatatttttcccttgaccattatctaaaacagacgtttggcgaaaaagtctaccgcctgtccttaaacggcgggatgacctgtccaaaccgtgacgggacactggattcgcgcggctgtattttttgcagcgccggtggaagcggcgattttgccactgccccttccctctctgtcacagagcagatcacgcaggcgaaagaacgcatccgcaggaaaagtaactgccggaagtttatcgcctattttcaggcatacacgaatacctacgctcccatttcctatttaaaagaactttttacggaggcgatcgcacagccggatattgccgctctctccatcgcaacacgctgtgactgtctcccacccgaagtgctcgatctgctctccgaactgaactgccaaaaacctgtctggatagaacttggtctgcaatccattcacaacgatacgctgcggcagattcggagcggtttcacttatgagcagtatttatctgcggtggacgccctgaaagatcgtggtctttccgttatcacgcatttgatcctcggattgcccggtgagacgaaagaaatgatgcttgcatcggtagacgctgttgcacatcttccggtagacggcgtaaaactgcagcttctccatgtactgaaaaataccgatctggctctgctctatgaaaaagcgccttttccagtcttttcccttgaggaatactgcgattttgttgtgaccagtatcgaacaccttccaccggaaatggtgatccaccgcctcacaggcgacggtccacgttcccttctgatcgcgccgctgtggagcacggataaaaagcgtgtcttaaatacgatccagaaacgttttcaggaacgggacacctggcagggaaaatattatacagatcaggcttagtttcgcaggaaagcggcaatcagcaaatagaaagaggtgtatataaatggctgaaccatttaccatatataaattaacgattttaaacatgttggataaagttgattttcccttgaccaatacacagatttcgaacttttttctcgaacaggactacactgattatttccgtgtccagcaggtcatcagtgatctggtcgacgccgatctgatccgtacagaatccacgcacagtaacacccagtacaccatcactgctgccggaaaagagacgctggaatttttcaaagacaagatttccgatgcgatcgaacacgacacgatggcttttctggaaaaaaacaagcttcagcttcgaaatgacaattccattctggcagactattataaaacgccaaatcaggactacgccgtgcgctgtcagtaccgcgaacataatacaaacatcatcgatctgacgttaagtgtcaaaaaccgtgcacaggcagaagcaatctgcaacaactggaaaaatctgaatgaagatgtatatgcgtatctgatggatatacttttgaagtagcagaaaggacttaatatggcaaaacagaactggaaaccgggaaatatgctctatccgctccctgcggtcatggtgagctgccagagttccacagcgcacgatcctctgtgtgagagaccggaattagatggaaaaccgaatattattactgtcgcatgggcagggacggtctgcaccaatccgccgatggtttcgatctccgtccgcccggagcgctactcttatcacctgattgaggagtccggcgagtttgtgatcaatttaacaaccgaaaaactggtgaaagctacggactactgtggggttcgctccggccgtgatgttgacaaatttaaagaaatgcatttgacgccgctcgcctcaaaacacatccacgcacccggaattgcggaaagccctgtgaatatcgaatgcaaagtccgtgagatcaaacctctcggcagtcactctatgatccttgcggatgttgttggtgtgaccattgacgataccctgctcgacgaaaaaggaaaattcgaattaaacaaaagcggacttgtcacttactcccacggcgaatacttcctgctcggcaagaagcttggaacctttggatacagtgtaaaaaaagagaaaaagcgaagtcgttagactttggctttttctctacgatcattttcttcacttattctttacaatttcatttttcctgagtaccttctaaatcattttctttgtatattgcataaacaatgtctatgattaccccttcatccgttagttccatttcattataaaccacctgaatacgctcaccagctgctaactccgggattccattcgatgataccacttcttttggaactaataccatatcaccggtctccctaattgattccgaatcatccggacttacaataaaataattatctgttattttcaaaattatccctgtaaaataattttgtgacttttcattgcatccaccaaccagcaataaaacaatagcaaataacatacataattttttcttcataaactatctccagtccaattgaggcatacctatatttaccactcctgcataaacgtttatcaaatcaaaacatatattatcaattctttattctgccttctcgcatttaaatcccattatactgctcacaataaaaaatacgatattgcaaatgttcaaaataaacgtaattgcactgccacttaaattattttcatccacataacagccttccgtccagacaataagatttgataacacaacaataccaagattattaacaaaatacattattttattaataggtttctgttttttcattgcaaaacttactgcaataagattgcaaacagatattgccaagcaaatacattctgctgcctctaagtatttaaccatttctaaatccccctcttcccgaaatcattcaaatactatcttaataccatgctcttttcatttcttttataatacagcattatatatcttatatcaatgtttttacaatttataatatcgtattcaaagcaaaataatatcatgtttatataaaaaaatagagaaactatatctactatagtctctctatctttctatttccacctgtaatattatcactatgctataagcaaaaattatttttacctactgcaccgacaaataagaatatcccatcaggctttcatccacttcccttgcagcttcgcggccttcgcggatcgcccacacgacaagcgactgtcctctgtgcatatcacctgcggtgaaaacatttttcacattggtcgcatatgcgccctctgcggttgcgacattggttctcgcattcaggtctaccccaaacgcattcgcaatataattctcagctcctaagaatccggctgcgatcagcacaaggtctgcatccattttctgttcggaacccggcacttctgccatcatcatacggcctgttttctcgtcttttttgctctctaatttcaccgtgacaagtccacagagatttccatttttatctttcagaaattcttttaccgtggtctgatagatacgtgggtcatgtccgaatactgcgatcgcctcctcctgaccataatctgtcttgcagacttttggccactccggccacggattgttctccgctctcgtatccggtgctttcggcatcatctcaagctgtgtcacactggctgcgccgtgacggatggatgtgcccacacagtcatttcccgtgtcaccgccaccgatgatgaccactctttttccttttgcagaaatgtactgattgtctttcaattcagaatccaaaaggctttttgtggtagcttttaagaaatccactgcaaaataaatacctttcgcatctctgcccggtgccttgatatctcttggatttttggctccacatgccagaacgaccctgtcatattcttttaacagttttgcagctttgacatccttgccgacattcgtatttgtgacaaatgtaatgccttcctccttcataatggaaaccttgcggtcgatcacccatttttccagtttcatattcgggattccgtacatcagaagtccgcctaccctgtcatcgcgctcgtatacggttacaaggtgtccgcgcttattcagctggtctgccactgcaagtccggcaggaccggaaccgatgactgcgactttctttcctgtgcggactctcggtggttttgctttcgcatagccctgctcataagcgttctcgataatgccatgttcgttttccttacaggtaacggcatccccccagtgtccgcaggtacatgctgcttcgcatagtgcaggacatacccttgatgtgaactccgggaagttgttcgtctttttcagacggttgtatgcctgctcccagttccctgtgtatacaagatcgttccactccgggacaaggttatgtaacgggcatccgctcgtcattcccatgatattcattcccgcctgacagaagggaacgccgcagttcatgcagcgtgcgccctgtatctgctgttcttcctttgacagtggtgtgtggaattcgttaaaatttctgatacgctccaatggtgcttcactcaccgatgtctctcttttataatccataaatccggttggttttcccatgatatttcctccattttcttttcgtattccctactgacgatcaacctctcgtattcgcatagaatgcttcgatctgtgcctgttcggatgagagacctttctcctccatctgaacgatagccatcagcatacggttgtaatcatacgggattactttcttaaatttcggcagatactcactgaagttatccagaatttccttacctttttcggaattggtaaatgccacatgctctttgatcatgtcttttaattccataacatcgtatttattggatacttcctcagaaaataccatctctttgttcatgcgggtgtaaaggtcgttatcctcatctaacacatatgcgataccgccgctcataccagccgcaaagtttttgccggttttacctaaaactacgacacgtccgcctgtcatatactcacagccatggtcgccgacaccttctacgactgcggaagcgcctgagttacgcacgcagaaacgctcgcctgccacaccgctgatgaatgcttttccgctcgttgcgccataaagggctacgttaccaatgatgatattctcgtcttttttatattttacacctgccggggcataaaccactagttttccaccggaaagtcccttgccaaaatagtcgttggaatcgcctacaagctctaaggtcagtccttttggaatgaacgcaccaaaactctgtccacctgcgccggtacatttaactacaaacgtatcttcctctaagccggttccatacttttttgttatctcggaaccaaaaatcgtaccgaaggaacggtctgtgttcgtcacttccacatcaatgcttctgcgctgtttgtttgtaagtgcagagccaagctgttttaaaagtaccgtctcgtcttttgatttttccagttcaaaatcatatacatgttttggatcaaaggttactttctccttcggtcctgcatatgggttgtttaaaattctggaaagatcgatctctttctcacgtccggtcagatcttcccggacttttaagaggtcgcttcgtccaaccatctcatccacggttctgcagccaagttttgccatgtattcacggagttcctctgcgataaacttcataaagttttccacatattccggttttcctgcaaaacgttttcttaattcgggattctgtgttgcgatacctgccggacaggtatctaaattacagacacgcatcatgacacatcccatggttacaagcggagccgttgcaaatccgtattcctctgctccgagaagcgctgcgatcgcaacatcacggccgctcattaattttccgtctgtctcaatccttactttattgcggagtccgttcatgatcaaagtctggtgtgtctctgcaagtccaagctcccaaggaagtcctgcattgtggatggaacttgccggagcagcacctgtaccgccatcgtaaccggagatcagcacaacctgtgcgccagcttttgcaacgcctgctgcaacggttccgacacctgcctctgaaacaagttttacggaaattcttgccgctctgttagagtttttcaaatcaaagatcagctgctctaaatcctcgatggagtaaatatcatggtgtggtggcggagaaattaaggatacccccggtgtggaaagtcttgtctttgcaatccacggataaacttttttgcccggaagatgtccaccttcgcccggttttgctccctgtgccatcttgatctggatctcttccgcactgactaagtactggcttgtgacaccaaatcgtccggatgcgacctgcttgatcttggagcatctgtccactgcggtatttttacttgcgatacgctcgtaatcctcaccaccttcaccggtgtttgatttgccgtgaagccggttcatcgcaatagcaagcgtctcgtgtgcttcctgtgagatagaaccataggacatcgcaccggtcttaaatcttgtcacgatagaatcaacgctttccacttcctcgaccggcacaccttttttcggataattgaaatccatcagtccacggatgcagccgtctttttcctcactgtccacaagctctgtgtactgtttgaacagattgtaatctccacgtttcgtggattcctgtaacagatggatggttgccggattgtaaaggtgctggtctgcaccacttctcattttgtggcgtcccctgctgtctaaggtgaggtcagtctctaaaccaagcggatcgtatgccgcagaatgtaattcgttcacatcattttcaatgtcttttaatgtaataccaccgatgcggctcacggtatttgtgaaatacttatcgatcacgtcggaatcaataccgatcgcctcgaagattttggaaccttcgtaagactggatcgtggaaatacccattttggaagcgatctttacaataccatttaagattgctgcattgtaatcatccactgccgcatagtaatctttgtctaacatatgctcatccaccagctgttttacggtatcctgtgccagatatgggttgatcgcacaggcaccataacctaacagtgttgcaaaatgatgtacctctctcggctcgccggactctaagatcatggcgactgccgttctctttttcgtcttgaccagatgctgctgcagggcggacactgcaagcagtgatgggatcggcacatggtattcgtcgacaccacggtcagacaggatcaaaatgtttgcgccctccctgtacgcacggtctgcttccacaaacagacgctcaatggctttctcaaggcttgtgctcttataataagtagtcgggattacttccaccttaaatccgtccactttcatatttttaattttcatcagatcggtattcgtaaggatcggattattgacttttaacacctgacagttaatggctttttcttccagaaggttgccatcctctccgatgtatacggttgtggaagtcaccactttttcacggatagagtcgatcggcgggtttgtaacctgtgcaaatagctgcttgaagtagttaaataacggctgatgatcggttgccagtgcagcaagcggtgtatcaatacccatggcggatgttccctcgccgccattttttgccattggtaaaattgcatccctcaaagattcataggtataaccaaatgccttctgcattctctgacgctcttccttggtgtattccggcacacgctggtttggaatcttcaaatcttttaaatttaacaggttgcggtcgatccattcaccgtaaggctgtttgcctgcataagtttcttttaactcatcatcatcgatcactcttccctttacggtatctaccagaagcatttttcccggacgaagtctctcttttaccacgattttcgtcggatcaatgtcaagtacaccgacctcagaggaaagaatgaggtaatcgtcatctgtaatgtaatagcgggaaggacggagtccattacggtcaagcaccgctcccataatatcaccatcggagaaaagaatggatgcaggtccgtcccacggctccatcattgttgcgtaatactggtaaaaatcttttttcttctgggacatgaggctgttgtttgcccacggctccggaattaagatcatgacagcgagtggaagatccatgccgctcatgacaaggaattccagtgtattgtcaagcattgcagagtcggaaccctcggtgttgacgaccggaagcactttctgtaattcgccctttaaaaattcggactccatggtctcctcacgggcaagcatcttatctgcatttcctttgatcgtgttgatctcaccgttatgtacgataaaacggtttggatgtgctctctcccagcttgggtttgtgttcgtagagaaacgggagtgtacggttgcgatcgcagattcataatctttgtcctgaagatctgcaaagaacaagcggagctgctctactaagaacattcccttgtatacaatcgttctgctggataaggagacaacataagtatcatcattcgactgctcaaacacacgtcttgccacatacaacttgcggtcgaacggaagtcccttttccacattcttcggacgctttacaaacccctgcataatgcaaggcatacagtcgatcgctttctgtccaagctttgtcggatcgatcggtacttctctccatcctaaaaattccatgccctctttctggacaatgacttcgaacattttctttgcctgattgcgttttaactcatcctgcgggaagaaaaacataccgataccataatctctctcaccaccaagttcaataccgagcggttttacggctttcgtaaaaaatttatgagaaatctgtaaaaggataccaacaccgtcaccggtctttccttctgcatcttttcctgctctgtgctttaagttttcaacaattttcaaagcattctccacggtttcatgtgtcttgatacctttgatattgacaaccgaaccgataccgcagttgtcatgttcaaatgccggatcatacattccgtctgtttttgtctgggaatcctttggtgcaaatttgttcagagtgaccatttttgcagatgtttctttctgttgctctttcatacgcaaattcctttcttaatccagattgaaatcgccactttgcagacaatttctaattacggagccttttggggtaacaggaacattgcaacgtaatttcctattacataaaaaggcgcttaaataacccaatgatcgattgggtatctaagcgcctttgcttcatgaattattttatttttcttgttttctaatgtacaactttttgatacttctgtctatctatttttttgcaatattgtctgataatttgaatatttattatttatagcagtattgtttatactattataattatattcttactgtaatatatggatacaaacaattctttccttgttttataataaaaaaatttttgattttcaagtgataaaatatcacttcaggtgtttttctggaattgtgtttgaattgtcggagtatagaatattactatttgttacggcagattttaatattctgttttctgtaataaaaagttgtgatacatggtagattatctgatcactaaccaagacaggcatcagtgaaatatcggcttttattatgcccgcacgtcaaacgactgatatctctgttgttttttctgcaattcctcatcggacaatttctgctgtaactctgcttctgaaagctgtccagtagtttccagatttccttcctgcgcatcgattgattccgacatatcatccataatttcggataaaacacccttatcatcggttttgccgtctgttcctgctgcctcgccttgagcctcctttttctgctcttcctcggtctttggcttatatttctcagccgctttcgccatctgctctccgcgctcttctgcctcatctaagatgtggaacatctgtgagctgttgtactcctgttttgctgccgcaatctcatcctcgtaagtatgaaacttctccagcttttttgcaatttcttcgattgtatccgctttctgatttttgagattctgcttctgtgtctcaaaaaaagcaatttttccgtcccgctcttcctgtctctgtattttttccctcgtgctttttaacatgtttgcatttgactgccagggtgtggacgtgtttttggaaaagttgatcgtaacactcataatagttctcctgtcttatctcctctgcaaatttgtcaattttcttttttatccccagaaatcgtatttactcgtctcaagtgcactcagcaatgaagagccgttcgatgtatactggctcgatgtgctcacaacattggacgctgcgttctggctgattcttccgctcacaaaactgatcttggaagcaagcccggtatctccatccaacactttctttaacgtgtctgcatctgcactctgtaacactttctcgtcaatggaaagactgccgtcttttgcctgtgtgataccaatgctcttcaatgcctctttgtccccggcaggaatatcctttaactgctgtctgtaaaactcatttaaagtatccccggtttccctgagctgttttaacgttgcgttgtagctctcgaccattttttttgccgaggaaacaatatcctttgtactgccgctttcctttgccctgtcataaatggagttcttatctgttgccacaagactagaagcatatccgttcaggttccccgaaatatcttccagcttcgaataattctttttctttgcgatcgccgttgcatccgcactggcattcactccgttcagcagaccggaaaaagatgactttttgttcaggatatctaacagtgttgtctgctgaaatggaattccgctttttgcggctgagtgtgcaagcatttgtgttgtaattcgcatattattgcctccctgtatgtcttgccaaaactgcaccataacgatgcattttgcctttctttactccgtatatcggtcgggcattttctgattttagcgaattgtaacgaacaggctcttttatgtaatgaaaaatcagcagatctatgttccgctgatttttgcttttttccgctattttgcagtccttttcatcctgcgcttctcagatatttcatataagccgtgacaaaatcgttatacttttgttttgccagataaactttgtcaccatttttcatctgtatcgtggtcgcatcatacttgtacacttcccgcagatttaccagaaatccccggtgcgaacggaaaaaaccctctcccagccgcttctccaacacttccattttctcataaaaagtataactgctctccggcatatttttcgtgtgcagcacaatcttgcgcgcctcgttctccgcatacaaaatattttttgccagaacttccatataactgccatctgcttttatcaacagggacatttcctctttttcccgctcaagctgccacatggcgcgctgcatcacttccgcaaacttgtgctcgtccaccggctttaacagatagtgaaacgccccgacatcataaccttcaaacacatattctttgaacgctgtcacaaaaatgatcatcgcattggatgtctcccggattttccgggctgtctccatgccgtttaacgtctgatttccatcttctccacgcagggaaacatccagcaggatcacatcaaaggatgtctgatctcgtaacagtgcctctccgctgccaaacaggcgaacctgtgaatccgggatacatttttcggtcagactttttaaatactctcttataggctgttcatcatcacatatcgcaattttcggcattttcttcactccatactctgtactttatcttatatcgaccagctcataagcttttcttatggaatatgtaatgaaatgtcgtttttatgtaacgaattattttctccggtaaaaaaggctgacaacggctattcctgccactgccatcacaaccgtaaacaaaatgccgtttaccgtcggataaaaactgaactccagccatcctgtctccgtccgcagcaccgccacaagatttgccgcaatatgcccaaaaactgccatggaaagcttccctgttttttccaacacaaacgcaagaagcaatccgatcaccgccgcatacaaaaactgcaccagattgacatgcatgataccaaagataagtgctgaaccgatcaatgccggtgtcacgccaaaataaagcttcagacgcttgtacaccacaccgcggaacagcaattcttctgcgattggaatcacaaggcaggaaccgagcagttcaaacacaaccgttcccgcaaaaaaggactggtttgcctcctgaaacccctccgacatctgcactaacggcgtcattgcaatgatgttattcacggcaatgccaagtgttgctgcacccacaacagccaaagctgcgtctgtgagccattttttatccaatttttctttttcagttccatagacaacctgctctgcaattttatcctgcttataaaaactcatcgtcgccgggatcgttgcagccgagcagataagctggcgcagcatataggtctgttgcccatcccccagaaaaagtcccagcacgaagtacataaggctcgacacaacataataaataccaatcggataaatgatctgccagagtttaaaaccgcctgtcgttttcatgatatcttcctttctatcgcatctgctgcagtgcttccacaacctctgccatgttgtcgcagacacagtatgcccctgcacgctctaacagttctctttttccaaatccataggatacgccgacacagcggattccaaactgatccgctccaatcacgtcatactcagtgtctccgatcaggcacatctggtcttttgtgatctgcatatgctccatccgtctgccaagctcctctagtacctgctgtttggtgctgatgcttccatctaaagtggaaccgacgatctcatcaaaatacggtgtcagggaaaaatgttccagaatacgtctgcacgctgtctccggcttggaggaagcaagtgcgatgacgcagcctgcttcttttaacttgcggatcgtatctgcgacaccctcatataattcacactcgaaaattccggtcttatcaaacctctcccggtattttaataccgcctgccatgccttgtccgcatcaaagccgtatttttcacggaaaacaggatcaagcggcggtccgataaaacacaacagctttttccggtccggttcctcaattccaaaactgcttaatgcatattgtacacactttgtaattccctcttctgagttaatgatcgtaccatccagatcaaataagactgcttttatcatattacctctctttcagttctccaagtaactgcgacactgtttttccaaaaaccggatggcggtaattcgggcaaagttctgccagcggttttaacacaaagtcacgattctgcatatcaatatgcggtatgataagattctcatcctcgtacacaagcttatcataaaaaataatgtcaagatccaatgttctaggtccccagtgaatgatacgctccctgttagcgtgctgctcgatctcatgcagtttctccaacagctcctgtggtgataacagcgtctttaatgcgatcgccccattaacaaaatcgtcctgctccactccgccgtaaggctttgtcaccagaagttctgacactcttacctctttgatctctttgatccggcgcagttcgtcgattccattcccaatataggcattcttgtccccaagattggaaccgaccgcaagatacacctcatgccactgccgtttcatcgtcaccgacacattttcaaatggaagcccgattggagcatgtggtttacataactcaatctctactccttttaacaccggcatagaaagaagcatcgcttccgctaactgctctgcgacgctctcaattaatttgtatgtatgatcctgtagaaaatctgtgataaaatggctgacttcgccataattcaaagaatccgacagattgtctgtctttccagcttttctgcagtccaaaaaaagttttgcattcacgtaaaagtcctgtccatcccttgtttcctccggaaaaaccccatgatgtgcaaatacttttaaattcgttattttaataaaatctcctgtcatcccgatacttcctttcagcacttctatcttcctgttatctaaagcctgcaaaactcctgaaaaaacaggtgtttggcaattgcttattttctgtccaggatcgcctctgccatctggattgcccggtgattttcttttacatcatgcacacggacaaacatacagcctgcttccaccgccatgaccgttgtgacgatcgttccctccacacgctctgctgccggaaggtcaagtgtcaatccgatcacagacttccttgaggtgccaagtagcaccggatattttaattcattgaactctttcaggcggcggatcacttccagattgttctcataactttttgcaaacccaacacccgggtctaagataatcttatcgtccgcaattccagccgctttggcaagtgcgattgtctcccgcagatcctgcttcatgtcctccataaaattccggtactcagtattgtcccggttatgcatgagacagcacgccagcccggattttgcaatgacttctgccatgcgcgcgtcatatttcagtccccagatatcgttgatcagatcggctcctgcctgtgccgccgcctctgcaacgccgcttttataagtatccacagagattggaatcccaaactctttttttaccgcctcaatgaccggaaccaccctgcctgtctcctcctcatcggaaatctttgtatatccccacggccgtgtggattccccaccgatatcgatcacatctgcaccgtctcttatcatctcttccgcatgctttaatgccgcatcaatctgattgaactttccaccatcggaaaaagagtccggtgtcacatttaaaattcccataatataagtatgtcctgttgttgcaaaatccctgctgcctattctcatttttctaaccttcctgaccttttatcgcaaataaatggtttctatcctctcaccaactcaaaaaactgtctctgaagcctctcatcctgttcaaaaacaccgcgcgtcacaaatgttaccgtcttgcttcccggctttttcacaccacgcatcgtcatgcacatatgctctgcttccagcatgaccattgcgccctgtggctttaaatattccatcaatgcatctgcgatctgtgccgtcaactgttcctggatctgcggacgctttgcatacacttccacggttcttgccagtttgctgagacctacgacttttccatccgggatatacgcaatatgcgcttttccgtaaaaaggcataaaatgatgctcacaggtcgagtaaaatgtaatatctttttcgagaaccatcgcattgtctttcacatgaaatgtctttgacagcggttcttcagcggtctgcgtcagtccaccaaatatctcttcatacattctggcaatgcggtcaggggtatcgagaagcccttctctgtccgggttttccccgattccttccaatattaattttacgccctcttgtattttctttttatccatcttttttccttctttaccgatactgaaatgatatggtccacgtacgatactgcattcctatgtacgcttttatcgatcaatccgactgcatgatctgcctgatctctttgagataagataaggagccaaatgcaaggatcacgccgtctttcttcgtgtgttccagtgccagctgcactgcttccttcatggaactgcatgcactgaccttcggaagcggttccatacctcctgctccctgtggactattttctgtgccctgtactttttccggctttccggctctctctttccacagacgagccacgatcgcttctgcctcagacgcaagttcttccgctttcatcgccctcggattatccggcgtcactgtaaaggcggctcccgcataaggcagcattgcctccagcacttttttgtgttccttatctgcaagtacacctattatataagttattggaatgtttgtaaaatatttttccacagacgcacttaattgaagtgccgcatcctcattgtgcgcaccgtctatgataaacagcggctgttctcctatgatctcaaacctgcccggccacacggtatttctgatcccgtctataatgatccggtctgcaattccaagaacctcctttaacactgtgaccgccagacagcagttttccacctgatatgtccctgtaagccgggttgtcaccgttccaagtcccggatgatcgaatctgatctcttttaacgtttcggtttccaccgttaccttggaaacatcggcggtataaagccttgcatgctgtttttccgcctctgcttctatcgcctccattgcctctgctttttgcaggatggtcacgaccggacaatcttttttgataatgccggcttttgcctgtgcaatctcggtcagtgtatttccaagaaattgcatatgatccatactgactgatgtaataacggagcacactggctttttgatcagattcgttgcatctgttctgccgcccattccaacttccaacagtacataatcacattttttctgataaaaatacaaaaatgccatcgctgtttccacttcaaaaatcgtcggatgttccatacctttttccaccatgcggtcacaggcacacttcacctgttccatgatatccgcatactcctcgtggctcatggactgaagattgatccgccacacttccatcggatcaaacaccgccggggaactatatctgcctacccggtatccggcttctatgagtacccgctctaaataagccccggtagaaccttttccattcgttcccgcaatgtggatgatcttaagctgctcctgtatatccccaagctcgtgcattaaattttcaatactatcaagtcctaatatgcttcccgacctgctgacatttacggcatacgctcttgcctgcccgtaattcattttcccaccttacttcttttgattttatttaacgcttcgttcccttggtgtcacgatttccaacacgaagtctgtttaagacaacctcttttccctttacttcaacggtctgctcgctctcgccgtctaacacataaatgttactcaatgcatctcctgcattcagtttcatgccacgcacgccgactgctccctttttcttttccgggattgtggaagcctcaatacgcaaaaacatttctttctcagactgcatgacaaccgtctcctcacctgtcattgcgtgcacgatcagaagttcatcatcctcatttaacttcgttgaggctgtcgttctctttgccacgtcaaattcacttccgtcaaccatcttaagcatggctgttttggttccaaataataatctggagtgaatgatcgcaccgaggttgataatgtatataaagttttcctcactactattgtagttacttagattgtcgattggaattcccttatctcggaactttccatatggaagatcaagcactttcaacagatgcatctgtcctttgtttgtaaaaatacagattttatccgtgttcttacaggttaagatgtaacggttttccgtatccgctgcctctttatttctctcatagacactgacatccaccgtttttgcatagccaaagcgatccatgaggaacaccacatccatctcctcaatcttcttctcttccacaaccgcttcctcaagattgtcgatcagagtttttctcggaaccgcatactgtttcttataagactgaagttctttgatcagcactttcgccatggtggcacggttttccaaaatgtcctcatactcggcgatatgctttaacgtatcctcatggtctttcatcaatgcctcgatttctaaaccgatcagcttctgtaaacgcatctccaggattgccgtggtctgacgctctgtaaaacggaggtctgatgccattttttctgactgtgccgatttaaaggtgatattgtccgtcacaccatcggtcagacatgctcttgcatcttttacattcttacttccgcgaaggatttcaataataaggtcaatgacatcacacgccttgatcaatccttcctgtatttcttttttgtctaattcctttttcagtaatgtctgatattttcttgtggcaagctcatactggaacttcacatgatgacggatgattggcacaagtcccagcgtctcaggccgtccctccgcaactgccagcatattcacaccaaatgtgtcctctaactttgtctttttatacagcagattgatgagattctgcgtatcggctccttttcgaagctctaacacaatacggattccctctttggaggactggtttgtgatatccacgatatcatttgttttcttggtctccacgagactgtatacatcattcaaaaattttccgatgttcgcaccgatcatcgtatatgggatctcagtgataacaatgcgctcttttccacctttgacctgctccacttccacttttccacggattttgatcttacccataccggtggaatagatctggatcagatcgtccttattggcaataattcctcctgtcgggaaatcaggtcccggaatatattccatcatctgctcagtattgatatccggattcttaatgtatgcgatcacaccgtcgatcacttcgcccggattgtgcggtggtgtgcttgtcaccataccgaccgcaataccatcggaaccgttcaccaagagattcgggatcttgaccggcaaaacttccggctctttctctgtctcatcaaagtttggcacaaaatccacgacatccttatccagatccgataaaaatgcttcctgcgtgattttctgcagacgcgcctccgtgtaacgcatcgcagctgcgccatctccctcgatagaaccaaagttaccgtgtccatctacaagcggcagccctttcttaaattcctgggccatgacaacaagtgcgtcataaatagaactgtcgccatgtggatgatatttacccatggtatcgccgacaatacgcgcacatttacggtacggcttgtcataccggattcccagttcgtacatatcatataaagttcttcgctgcaccggttttaagccatcgcggacatccggcaaagctcttgcgataataacactcatcgcataatctatataagatttctgcatcagttccgaatactcggtacggataatctgttcttcctgctgcatcatataacctctctatctgttattctacagaccattgcaaaatgtttgtcatctgctttacgatttttcaatgatctactgctatttttaccgtctgcactatacgtcgagttctgcgtcatgcgcatgttcataaataaatgtctttctcggtggaacatcatttcccatcagaagctctgtgatatcagaagccatgcggccgtcctcgatttcaatccgctttaacattctggtagccggattcaatgtagtctcccacaactgctcggcatccatctcaccaagacctttgtaacgctgtaaggtaaagttacttcccttatgtgcttttctgtatttttccagagccgcatcatcgtaaagatactcttcctcgcccttgcccggaataactttgtaaagcggcggcattgccacatagacatgtccttcatagataagttccggcataaaacggtaaaacaatgtcagaagcagtgttgagatatgtgctccatccacatcggcatccgccatgatgatgatcttgtcataacgaagttttgtgatatcaaaatcgtttccatatccctcggaaaaaccacatccaaacgcattgatcatggtcttgatctctgcattggctaacaccttgtcaatacttgctttttccacatttaagattttacccctgattggcaggattgcctgataatttctgtctctcgctgtctttgcggaacctccggcggaatctccctcgacgatgaagatttcacagatggaagcgtccctgctctcacaatttgcaagctttccattggaatcaaacgaaaacttctgcttggtgagcagattggtcttggcgcgctcctcggtcttacggatctttgccgctttttccgcgcaggagatgaccgttttcaatgtctctaagtttttatcaaaaaataactgaatctcgtcgccggtcacttttgcagtggctttcgccgcatcctgattatctaatttcgtctttgtctgtccctcaaatctcggatcaggatgtttgatggaaacaactgccgtcattccgtttcggacatctgctccggtgaagttcacatctttttcttttaaaataccaagttctctcgcataagaattaatgacggttgtaaatacggttttaaatcccgtgatatgtgtaccaccctcggcattaaaaatattattacagaatcccaggatattctcatgaaattcattcgtgtactggaatgcagcttccacggtaatgccttcagattcccctttaaagtagacgacatcatgaagcacttccgtatttttattcaaatcctttacaaaaccacggattccatcttcctcatgatatacgatatgttcgacttcctcgccacggcggtcctcataaatgatcgtaagtttcggattcagatatgccgtctcatgcatacggcttttgatctcatcctctttgaatctcgtcttttcaaaaatttccggatctggaagaaagtttactttggttccggtcttttttgtcttgccaatcttaggaagcaatccattctccaattccacaaccggaacgcctctctcatagcggtcgtgatgaatatacccctctctgctgatctccacatccatataaacagacaatgcattgacaacggaagaacctactccgtgaagccctccactcgtcttatatgcggaatcatcaaacttaccgccggcgtgtaaggttgtgtatacaagacgtgctgccgaaacacctttggcgtgcattccgaccggaacgcctcgtccattatcttctaccgtacaggaaccattcttctccaatgtgacatggatcgtatcacatgcccctgccagatgctcatccacagagttgtctacgatctcatagatcaggtggttcaatccctttctggaaacacttccgatatacattcccggtcttttccgaacagcctctaacccttctaaaaccgatatgctgtgctcatcataacctgccatttcttacctcacttcattcattttcctgcgctctgtcacaaacttgcagattcatttcataatattctttcaaatctgccctactcttctaccttctgctggttcatatgtgcaatgaccatcatcgcaatcttaaaggtcattgcatcatcaaacttacggatatctaatccgattgccttctctaaacgttccagacgatatactaatgtattccggtgcacatataactgtctggcggtctctgagatattcagattattttcaaaaaacttctggatggttgtattaatctcttcattaaatatatccggcacttcatccccgaacacttcatgaataaacatctcgcataagctcatcggaagctgataaatcagacgcccaattccaagcaggctgtatgcaatcgtctcacgctctgcataaaaaattcttccgacttctaacgccatcttggcttcctgataggatttggcaatatcttgcagattatgcacacggtttccatagcccacgcgcactttcaccatcgcctcagtgtgcatattatccacgatcatacttgccaatgtctgcagttcttcatcttctttcatgtctctggtatctttgatcaggacaatgctctgctcgtccacttctgtcacatagtctctggtcttggtcacgaacagattcttgactgtctccatcgcggttgcatctttcttgccgtcaatctcaatcacgaaaacaacacgttctgcctgttcaatatgcagcttctgggccttattgtacatgtccaccacgagcatatttccaagcaggatattctgcataaaattattacggtcaaactgctccatataagcggctgcaagattccttatctggcaaactgccaaccgtcctaccatataagcatcttctgcggatgactttgtcaaaagaatatattccacttcaccctctaccattactttaaagaaatgacaaccggacagcatctggctctctgccattgatgctgcaaatgaagttaccgcctcttccatatcgccttccagctcaaaagtagccgcaacctgtttgcctttctctgaatataatgccaaatcaatcttggaaatctccttgatctcgtctaaagcagtctgtatcttatggtttgatatcatacgctccattcctttcgttatttattatatagaacacatgtttgttttgcaattattttttgcagaaaaaaccgggtacaaatgatgcacccggttctactgagtttatttaattttaccgaattagttggtaattgtcaattcagtttctttatcgaagcagtgaatcttctctggatcgattgctaatgtgatatgatcacccatacgagctgttgttctggaatcaacttttgctgtcatggctgttcctgctacattgaagtataacaatacttcagaacctaataactcgtatcctgttacgtctgtctcgaatactgcatctttgtgagcttcgatctcaatctgggaatctccgatatcttctggtctgatacccataacaactgtctttccgttgtatccgccatcgatcaatttcttagcttttgccggaggaaggacaacagatgtcttctcgaagttaagagttactctctcgccttctactttacatacagcgtcgatgaagttcatctgtggagatccgatgaatccagctacgaataagttgttaggctcattgtataatttctgtggagaatcaacctgcatgataacaccatcttttaatacaacgattctggttcctaatgtcatagcttctgtctgatcatgtgttacatagatgatagtagcttttaatctgttatgtaaggaagcgatctcagaacgcatctgaacacgtaattttgcatccaggttggaaagaggttcgtccataaggaataccttaggattacgaacgatagcacgtcccatagcaacacgctgtctctgtccaccggataaagcctttggtttacggtctaataatttctcaagatcaaggatcttagcagcttcttctacttttttcttgatctcatccttaggaacttttcttaattttaatccgaatgccatattgtcaaatacggtcatatgtggatataatgcgtagttctggaataccattgcgatatctctgtcttttggctctacgtcgtttacaactcttccatcgatttttaattcaccggaagaaatctcttcaagacctgcgatcatacgaagtgtagtagatttaccacatccggatggtcctacgaagatgatgaactcctgatcttctacttcaaggctgaaatccttaacagcttcaaaaccgttaggataaactttacatacatttgttaatgataaacttgccattggtgtaaatacctcctgataaattgttcgtttcttgatatatttactatacaaaaaaacagccaaaaacgccatatgttacctacacaaagaatctgtcgatttcttgtaggaactcacagtgattttgactgttttttgatttcttcgtcagattgcactgatatttcatctttttccgtcaaattgacgaagcaacctgcctgtatcttttatttcatacattcatttctgatcataacttagaataaccgaatccattgaccacggcatccagcttgattccttttttacagaatggacagtcatctgcggaataagccgcatatcccggaagatcctctgcatggaacaccgagtgtaccgcaaagccatccatctcagataccgtgctgaacacagatgccactgcctcgatcacgccgccatagtaacggattccctcaagacttctgtggattgtctttccggttgtggtagatgcagataataagattacatgttttcctgcgatacttggtttgatattatcacggaataagagctggttattgctgttcatctccggcgaaaccacataaattgtctcatggcggttcgtagatgccatatcctctttttcaaattcctctgccaaaaacgctccgatcacctccgtgccgtccatacatacaatcgtatccacataggaaactcttccgatcttctgatgcagcacacgggcaacctctttcgcctcctgaattcttgtcttcaagcttgtgatatcaatatagtaattgatatgggaatgactggttgcaaaatgtcccggaattgcatgaattgcaaccatgttgctctcttttgaataaaactttaccattctgctttccataataaaatacctccttaaccccactattccggcattttccggatattactttcttccggtagaaccaaatccgccttccccgcgctccgtctcattcaattcttctacttcctcaaactcaacagaaagatacggcattacgaccatctgtgcaatgcgctcttttccggcgatcacacgctcctcatccgtatcattatgtaaggcgatcataaattctccccggtagtcagaatccactactccgacacaatttgccgggcgcagtccctgcttggaggcaagaccgcttcttgcaaaaatcgcaccgaaatatccttccggtatttccatcgcaagtcctgtgccgaccatcactgttttgtgtggtggaatcacagtatcctcagaactttttgcatacagatcatagcctgccgcctgactgcttccccttgtcgggagtactgcatccgcatcaagtttttttatattgatcttcatttatattctccattctagcacaatctgtcagatatattttttaattaaatcttaattcttccatacgtttttccctgcaaattataaggaactcctgcattcttaatcttcccagccaagattgccatgttccattttcttatcgcggagcatcaggtcattgaccgcctcttttgccggtttgtcctcaaataatactttgttgacttcctcaatgatcggcatatctacaccgtatttttttgcaagggcgatcgctgctttcgcagagtagacaccttctacgaccattttcacttcgtccatcgcctgctgcatggtgtaaccctgtccgatcagcattccggctttgcggttacggctgtgtttactctcacaggtcacgatcagatcaccgattccggtaagtccgtttaacgtctcctgttttgcgcccatcgtcacagcaagcttgttcatctcaaacattcctctggtgatgagtgccgctttcgtgttatccccatatcccagaccgtctgccattccggctgcaagcgcgatcacgttctttaacgaaccgccaagttccatgccaagcacatccgggcttgtatacacacggaaaacgttgttcatgaaaatgtcctggatttcctctgcaacagcacgttttttcgctcctgctacaaccgtagttggaagtccgattccaacttcttccgcatggcttggtccacacatcactgcaacctctgcctgcgggatctcctgctccacaatgtcagtaagcggcatcagtgtctcttcctcgattcccttagccacgcacacgatgatctgtccctctttcacaaaaggcgccatgctctttgctgtgcttcttgtgaatacagacggcactgcaaggatcaggtatgctttacctgaaaccgcagattccagatctgtcgtaaattccatatcttccggcagttttacccccggaagtttctgcacatgctcatgtttttctttcagcatggtaatctcatcttccacgatcgaccacactgtcactttatttccattggtatgcagtacttttgcaagggcgatcccccagcttcctgctcctatgatcgcaacatctgccattttttctcactccaaatcaaaaaattatttctgctccttctttttcgcaccgatcttattctctgtgccatttgcaagacgtctgatatttgcacggtgctgccatacccctaaaatggtaaaacaggctgtcactatgtaaaattccgcacggattcccattggaactgtgataatcccaagctgtccatatacgaccacctggacgaaaacactgatcagtccgatgattgagccgagagatacatactttgtcactgcgctgatcaccagaaaaagtcccatactgaccggtgcaacgatcggaaatactgcaagcaccattccaccggtacatgcaactccttttccgcctttgaacttcagataaaacggaaaattgtgtccgagcaccgctccaaaacctgcatacagctccagaagaatgatgtcttctgtatatgttcttccaaagatcagtttaacggctaacactgccgctactgtttttaaaatatcaccaaggcaggtcacaagtcctgccttccagccaaaggttcttaaggtgtttgtcgcaccggaattgccgcttccttttgtgcggatatccacacctttctttttcccataaaaataacctgtttcaaataatccgcaggcgtagccgatcgctactgcaattatcctggcgatgatcatttttcattttcctttctctctctgatgataaaacgaagggctgttccccggaatccaaacgtatcacggatgcggttctccagatatcttgtgtaggagaaatgcatcagctgtttatcattcacaaagatcacaaaggttggcggttttactgaaacctgcgtcgtgtaataaatacgcagtctctttcccttatccgatggcggctgctgcatcgcaactgcctcggtaacgatttcattcaatacaccggttgccacacgcatgctgttgttctcgatcacgacatcgattgtctcaaaaatcttattgagacgctgtcctgattttgcagagatgaaaataatctccgcatacggcataaagcttaagatgtcacggattttctcggtatggcggtagatggtcttatcatctttttcaatcgcatcccatttattgactgcgatgatgattccctttccacggtcatgtgcgattcccgcaatcttggcatcctgctcggtcacgccctcggtagcatcgatcacgataatgcagacatctgcacgctccacagctgtcactgcacggataatactatagcgctcgatctcttccttgatcttattcttacgtctcaatcctgcggtatcgataaacacatattcttttccattgtacttaatgtcggtatcgatcgcatctctggtcgtgcctgcgatatccgatacaatgacacgatcctcctgtgccagtttgttgatgagggatgattttccaacattcggttttccgataatggcgatcttcggacggtcgtcctcctcgtcatctttcttatattccgggaaatatttcaccacttcatccaacatatctccaagtcccaacatggaagcagcggaaaccgggaatgggtctccgattccaagattatagaactcatagacatctgccatatacttttcaaagctgtccactttattgacgaccagcacgaccggtttgccggaacggcgcagcatatctgcaactttggaatccgaatcctgcaagccctgtctgacatcgacaataaacatgatcacgtctgcagttgcgatcgcgatctctgcctgctctctcatctgtgataaaataatatcgttactgtccggttcaataccaccggtatcgatcatggtaaagttgtgatctaaccacgacacctccgcataaatacggtctcttgtaacgcccggtgtatcttgtacaattgaaatacgctcacctgcaagtgcattaaataacgtagactttcctacattcgggcgtccaacaatcgctacgactggtttactcatttaaaaaactccttttctcatgtatcacggaaagaactgggatctccactactttcctgttataaccttaaatggttttctaccgttacgctaaaaataacaataacagtttacaataaaaaagatggaataacaatatttattccatcttttttctgaactatgcgttttgtctaggaaatgtgcggtattcctttttcccttactgccgtaaccggattcatcagtgcgtcatactcatcataagtcataagttttcgctcactgttcaaaatcccaagttttttcaatgtctcaataatgtttgtgcatttgcttccgaactcaacataggcgctgtcactgtttgggaaataagcttctgcctcttctgcagtcttctcccctgtcagcaccgcttctgtcacatcaaccccatccacactgtaagaactgtaattccagatgataccgtccggattataaaaactgatatccagattgttaaaataacgatccctgtacgtgttatcctcatcaccggcacggagcgaataaagttgatagtacgtcatgtttcccgcttccacatctttctgcaccgcctccatgacagcgtcaagttcttcctgtgtaaaacggtaatcctctgttctgccgttctcatctacaaatgagatgctgccggcataatactcattcgtcttatagtaattgccaaacatgttctgcatcatcttatccggatcactctctaacgcagtcacttttgcgacgacagaatctttgtccgcagccgcagcctgcccaaccggaactgtataacttctccgcagcttcttaccatccttcagggtatatgtgattgagagataatattggttctctgcgctcaggcaatcttctttctgtgccaggatctctttctggagatctatgatcttctgaatatcatccggttcggtatagcggagcgtatagtccagattgagcgataccaccttaacctctgaaacatccggtatttttccttcgatccggaatagatccagtttcagtgcacccagaaatgctgccagaacaaccgttaagactgcccattccccaactctctttttgtggaacacacggaaattcttctcaataagcatctccgccacaaaaaagccgatcgcaccaaagatcagggtgcctgctgcaagtatccaaaaatgtacctttgccgaagaaaaactgtttccgatcgtgtcagcaacggcagttcctccaagcagaccggcgcagacagccacgccccagcggaacaccggcttgattccccgcatgctgataaggtcacctgcagtctccaattttctccatttatacaactgataggctgcgatcaggaataccacacctgccactgcataaatcccgagcagatatgcacccttaaactcgattccaaccgtcacatactcactgttttctactgactgtatccgcagattgtttgtcagataataaattggagacaaaatacaggatttccccggattccaattgtttgacaccccaaagcagacactctctatcaccatgttgatcagataccagcatcctacatacagataattgactacgacataatacaccggaaatgccatgagctgtccggtaaacatcgccacaaatgcgccgagcgccagtgcaaaaaacgtcattgcggcttctgcaccaaaccagtataaaatgtactggatattggtgatatgtgcaccaatgcagacgaacaccgtgataataaaggtcaggatctgcggaacgatcataaatgcagacgcagatatgatattcgtcacaaacaactcccgtctgtccaccggaagtgaatggatcatattcgtattctttgcagaatacagataggaaaacactgccatgatcatcactgctgcaaatgcaaatgtgatcaccggattcatggctgcccgcatagcgccactgatcgcatagacctgtctctggagctggctgtaactgtcatcctgcagataataccgcatattaaaccacagtccgaccggaagcgaaacgatcagataacagctgtacaatgcccacaaaggccagaaatgtgtcatattttttttgaaaattgttttgttaaagcaggatgtctttgacttcataatccacacctcccaattcataaataaagatttcctccagtgtcaacggaagtacatcaacaatggtaggattttctgtcagaagaactttctctgcctccttcggatcaccttttacgatcagggtatagacacgccctgtgtttgccatatgcagcacctcaaaatcatccggcaattttggcacaccattctgacatgccacctgtatcttggaaatatttccctgaagatcgctcaaagaccgctcgatcataatttttccatggtgcatgatgcccacatggtcacaggtatcctccagttccctcaggttatgggaagacactaaaactgtcattttccgctctgccacttccgccattaagatactccagatctgtctgcgcatcacaggatcaagtccgtccaccggttcgtctaagatcagcagatccggtttacagcagatagcaagccagaacgctacctgtttctgcatgcctttcgacagccgtctgatagtgcgtttcacatcgatcgtcgggaaaaattcctgcattttataaaaaagcttactgtcaaactgtggatagatgccttcataaaagcgtttcatctccatcgtatctgcctgcataaaataaaacagttcatccgggatataagccatcctctgcttgatgttccggttttcaaataccggttcaccgtcgatcaggatctctccctcatctgccttataaactccggtaagatggcggatcaacgtagactttcctgctccgtttggcccgaccagtccataaatatcaccttttcccacatgcatttccacgccgttcaacgcctgaaaatcatcaaactttttctttaaattatgaacctggatcattgtgcctctccccctttagccaattgttcaatacgtgttttcaaactgtcctcatccatcgccaaaaacaacagttccgtcaccacttcatcaaattccttcatcagttcttcatttctgacacccagcacttctttccgctcggcgacgaatgttccttttccggcaacggtatagacatatccctctgcctcaagttcccggtatgccttctggatggtatttggattgatggcaagcttcgaagccatttcccgcacggagggcagcttttcatttgcaataagggaattcgtgataaccagctttctcagaccatctttgatctgttcataaattggttttgcatccctgtaatttaactgaatcaaataacaaacctcccatctgtattagctgtatgatgtgtactatcattcttcatacagttaatatagcacgagaggtcttctattacaatgaagataatcctaggatattattaagaaatctttaatatgccattcttttcaaaggcagcatcgtttctgctatccgagataagccttcagaagttcaaacgtattctttactccatccacatggcttctctcataaccgtgtgatgcatatacacccgaaccgatcagtccgtggcgcacatcatatccggcggtcagcgcaacatctgcatctgaaccatagtatggatagacatccactgcaaaatcaatattgttctcttttgccgctttcacaagaccgtttaccacatcatagtgatatggtccgtggctgtcctttgcacagatagatacctgtgtctcatcacaggcaagtccgtcaccgacacatcccatatccacagagagcacttctgtcacgccttccgggacagaggctgcgccaccgtgtcctacttcctcaaatacagtgatgtgctggtagatcatacgctccggtgtcacattttcctctttcaaatattttgcatagcccaataaaattccaacacttaatttatcatctaagaaacggctcttaatgtaaccggattctgtcaccgtagttctcggatcaaagcagacaaaatcgcctgtcataatgccgagtttctccacatcctcttttgattttactttttcatccagaacaacttccacggaatcatagcttctcttcgtatcgttatattctccgtttacatgaatggaagcgttgatcagctgtaatgttccgtcgtattttccgttaaatctggtgacaactttacagttttctccctctgcattgtttgcattcatgccacctactgctgtaacacgaagtcttccgttggctttgatctctgccaccatggcacctaacgtatcaatatgtgcctctaaaagaacggcgttctctttgtccctgccgccgattggtacgagcacaccgccttttaccgtaagctttggctcatatccgagttttttgtattctcccatgacatagtctgccacctcttttgtgtagccggatggactgtcgattgcgaggatattctttgtctcttctaccatataatctacataatttttactcatatcttttgctcctttatctatttcaaatacagataattgcgaaactccttattgtttttgaattgtgagaaattaacaaaattttcgaaaacacgcttccgctacgtgtcgctggtaacggtactaagaagccagtcacgattaacatcgcacctgccttctaaggaccgaccgctccccagtgttttctcaagcttttgtcaatttctcacaattcaatttacgttctcatgagtttcgcagttatcttattttaaacataaaaatgccccgaggtttccgcgcttaccgtggcttgcgcggtgggaaaaaagtaagtcaggattgcagcacgtgcaaatgtccgtgatttctatatgttccggcaggacacctgcatcaagcagtacaatttcgtttgccttccagagatcgagctgatattttccattttcttttgcaagaatgatttcacgctcatgccctgcaaatgcctgctcaaactccaccgcaacatccccgctcacctcgtagcagtcctgacagatggacggtccgatcgcacagcgcagttcctccggtctgcttccgtattccatccgcatcgcctcgatagtcgcttttcccatgcggtttactgttccacgccagccggaatggcttaacccgatggcacgatgcaccggatcgacaaaatacagcggaacacagtccgcatagaacgttgataacactaagcccggcacatccgtgatcagtccatctgtatcatgaaattcccgttctctcgtaagtccatttccggcatcctccgccgtcacttttcttacatttgtcgtatgtgtctgatccgtaaaaacaaatttatcataatccacatcaagcgctgatgcaagtcttctgtaattttcccggactgcctcctcttcatctcctcttgtaaaactcagattcatggtggaaaaaataccctcactcacgccgccaagtcttgtggtaaaaccttcttttacgattcctgttttctccaataacggaaaatgtaaaagcggcacttccacgccagccccaggatgatgtatcacctctgccggcactcctgtattgtttttccgcttccagcttttatgttccatatcgcttacaactctcctgattttgtcctgcgaaaaagcagccataaaaatgcattctttcaccctctcagaacccctgatagtcaaatgcattctgaatgacttttatctgctctcccaaaattgccgccacatcaaacctgcaaggtgtatatgttccataaccatgtgtcaggcaataatacgaagctactttggaaatcgttctctgttttgcagcagtcaccgcctcaagtggatttcccgctgcgttgtccgcacggtatttcacttccacaaacacaagatatccgccctgtcttgccacgatatcgatttctcccatgcggcatctgtaattatattctaaaatctcatacccctgctgttccaaatatgcacctgccagtttttcataggcagttcccacacttctcttattgataaaaccctcttttctacagcagcatccttcttttgtgcctgctgtccctcattctattcacttcctgcagcacactatttgattatgccattcatctgctgcaatttcacttcatttatgataacatatctgcctgctgcaattttgccttcatcttatccatatcatccacaaacacaaggatctcagcgactacttcataaagttccggtggaatcgcatccccgatctctaatttcgatagcgtctccgccagcttattatctttatagaaagggacatcattttcttttgcctttgcgatgatcttttctgccacttcgcccctgccactggcaaggatcttcggtgctttatctcccggctcatatgctactgctaccgctgtttttacctttttcttttcattatcccatgccatatccgctcaccacctctgttttgtatctgatatactaggctctcacatcaaacgaataccgatgcagtgttcccgtctgtggcatatctttccgcaggaaatcatccccaaagctgaccttcttttcttcctttgtcatcgttatggtacactgataacctttgtctttcagcttttgttccagaatgggcagatacttttccacaagatcataggacgcatcgtcagccatataaaaatttgttttgacattccgatgctgcattttcactgagacatcggtagaaccaaggtgttccagctccaggtgtaaaaaagcactcagctccgcatccggatctctcagattctttttattcgtgtatacataaagttctccgtttgcattctgaccggacatcttcaatggcacctgtacatatgtatatgcctgattgagctgattcataaattcaatattaccgcgcacctctgccgcagtttccggaaatctggttttcgtaacgcctgcctctttcagcgcatcttccacctgtctcatctgctgctctaatttttcgtaaagctggctgatctttttctcctgtttcaacgcttccggctgtatcagccactgctgttccatcacattccgaagtagacttttatatgcatcacttccgaataatttttggatactctgcgatgccgctccattgttttcagataaaatctgtgatactgtgcgcagaaaatcggaaacggtcagatttttgtccaatgccgttttgccgtctgcagcttcccatgcagcgccctctgtcatcagattctgtgctacgctctcatcttccaacgtgtcgataaaaatatcctgctccatcgcttccgggaaaagttttgtactttctaccaatgaaggaatattctgcaataacttgccaagacttgaaaac
